United States Patent 11,479,782 (ALFALFA WITH REDUCED LIGNIN COMPOSITION) - sequence listing, part 3

SEQ ID NO: 12959 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12960 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12961 - DNA, 463 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtccagcgcctgcttgccaccgccattgctggtgatggccaccacctgctggggggtcaagccgtgggcctggcacagcaccggcaacagccgctggaccgtctccagctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgtgctaa

SEQ ID NO: 12962 - DNA, 463 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtccagcgcctgcttgccaccgccattgctggcgatggccaccacctgctggggggtcaagccgtgggcctggcacagcacctgcaacagccgctggaccgtctccagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 12963 - DNA, 464 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtccagcgcctgcttgccaccgccattgctggcgatggccaccacctgctggggggtcaagccgtgggcctggcacagcaccggcaacagccgctggaccgtctccagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12964 - DNA, 464 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtccagcgcctgcttgccaccgccattgctggcgatggccaccacctgctggggggtcaagccgtgggcctggcacagcaccggcaacagccgctggaccgtctccagctaaagctggacctggtgctcaaatttcacttgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12965 - DNA, 464 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtccagcgcctgcttgccaccgccattgctggcgatggccaccacctgctggggggtcaagccgtgggcctggcacagcaccggcaacagccgctggaccgtctccagctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12966 - DNA, 464 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtccagcgcctgcttgccaccgccattgctggcgatggccaccacctgctggggggtcaagccgtgggcctggcacagcaccggcaacagccgctggaccgtctccagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12967 - DNA, 464 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtccagcgcctgcttgccaccgccattgctggcgatggccaccacctgctggggggccaagccgtgggcctggcacagcaccggcaccagccgctggaccgtatccagctaaagctggacctggtgctcaaatttcacctgttcaaattgcttctcagcttccaacaactagccctgatgcaccagtcatgttggaccgaatgttgcgtctcttggcttgttacaatatcctcacttgttctgttcgtactcaacaagacggaaaggttcagagactttatggtttggctactgttgctaa

SEQ ID NO: 12968 - DNA, 476 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaatcgtccagcgcctgcttgccaccgccgttgctggcgatggccaccacctgctggggggtcaagccgtgggcctggcacagccccgccgccacccgctggaccgtctcccacgccttctacagctggacttgacgctcaaatttaacctaatgaaattgcttctcagctcccaacatctcaccctgatgtaccagttatcttggaccgaatgttgcgtctcttggcttattacactatcctcacttgtacagatcgtactcaacaacacagaaaggttcagagactttacggtttggctactgttgctaa

SEQ ID NO: 12969 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12970 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12971 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12972 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctgttcaaattgcttctcagcttccaacaactaaccctgatgcaccagtcatgttggaccgaatgtcgcgtctcttggcttgttacaatatcctcacttgttcagttcgtactcaacaagatggaaaggttcagagactttatggtttggctactgttgctaa

SEQ ID NO: 12973 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12974 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12975 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12976 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12977 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcggctcacaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12978 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctcctaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12979 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12980 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12981 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12982 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctcccaacaactaaccctgatgcaccagttatgttggaccgaatgttgcgtcgcttggcttgttacaatatcctcacttgttctgttcgtactcaacaagatggaaaggttcagagactgtatggtttggctactgttgctaa

SEQ ID NO: 12983 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12984 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttacggtttggctactgttgctaa

SEQ ID NO: 12985 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggttcggctactgttgctaa

SEQ ID NO: 12986 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctcccaacaactaaccctgatgcaccagttatgttggaccgaaggttgcgtctcttggcttgtgacaatatccgcacgtggtcagttcgtactcaacaagatggaaagattcagagacgttagggtttggctactaatgctaa

SEQ ID NO: 12987 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12988 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctaccaacaactaaccctgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 12989 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12990 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12991 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12992 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaagttcagagactttatggtttggctactgttgctaa

SEQ ID NO: 12993 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactttgctaa

SEQ ID NO: 12994 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 12995 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12996 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12997 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12998 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12999 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13000 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13001 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13002 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13003 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13004 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13005 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13006 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13007 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggacctggtgctcaaatttcacctattgaaattgcttctcagctaccaacaactaaccctgatgcaccagttatgttggaccgaatgttgcgtctcttggcttgttacaatatcctcacttgttcagttcgcactcaacaagatggaaaggttcagagactttatggtttggctactgttgctaa

SEQ ID NO: 13008 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggacctggtcctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13009 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggaatcattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13010 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13011 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggaataaagctggacctgatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13012 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13013 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13014 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 13015 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13016 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13017 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13018 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13019 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13020 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13021 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 13022 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgctacaatatcctcacttgttcagttcgtactcaacaagatggaaaggttcagagactttatggtttggctactgttgctaa

SEQ ID NO: 13023 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 13024 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaggatggaaaagttcagagactttatggtttggctactgttgctaa

SEQ ID NO: 13025 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13026 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13027 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctctcttgttcagttcgtactcaacaagatggaaaggttcagagactttatggtttggcgactgttgctaa

SEQ ID NO: 13028 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13029 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13030 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13031 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaacttcagagactttatggtttggctactgttgctaa

SEQ ID NO: 13032 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 13033 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13034 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgcacaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13035 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctaaagctggacctggtgctcaattttcacctattgaaattgcttctcagctcccaacaactaaccctgatgcaccagttatgttggaccgaatgttgcgtctcttggcttgttacaatatcctcacttgttcagttcgtactcaacaagatggaaagattcagagacttcatggtttggctactgttgctaa

SEQ ID NO: 13036 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13037 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13038 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13039 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13040 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13041 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagcctttatggtttggctactgttgctaa

SEQ ID NO: 13042 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13043 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctaaagctggacctggcgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13044 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagattaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13045 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13046 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 13047 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13048 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13049 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13050 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13051 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13052 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13053 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13054 - DNA, 438 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatgctgtgccaggcccacgtcttgaccccccagcaggtggtggccatcgccagcaataatggtggcaagcaggcgctggagctaaagctggaccgggtgctcaaatttcacctattgaaattgcttctcagccaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13055 - DNA, 438 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatgctgtgccaggcccacggcttgaccccccagcaggtggtggccatcgccagcaataatggttgcaagcaggcgctggagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13056 - DNA, 438 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatgctgtgccaggcccacggcttgaccccccagcaggtggtggccatcgccagcaataatggtggcaagcaggcgctggagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13057 - DNA, 438 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatgctgtgccaggcccacggcttgaccccccagcaggtggtggccatcgccagcaataatggtggcaagcaggcgctggagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13058 - DNA, 438 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatgctgtgccaggcccacggcttgaccccccagcaggtggtggccatcgccagcaataatggtggcaagcaggcgctggagctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13059 - DNA, 438 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatgctgtgccaggcccacggcttgaccccccagcaggtggtggccatcgccagcaataatggtggcaagcaggcgctggagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgaaaaggttcagagactttatggtttggctactgttgctaa

SEQ ID NO: 13060 - DNA, 438 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatgctgtgccaggcccacggcttgaccccccagcaggtggtggccatcgccagcaataatggtggcaagcaggcgctggagctaaagctggacctggtgctcaaatttcgcctattgaaagtgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13061 - DNA, 438 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatgctgtgccagacccacggcttgaccccccagcaggtggtggccatcgccagcaataatgttggcaagcaggcgctggagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13062 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13063 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13064 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagaggctttatggtttggctactgttgctaa

SEQ ID NO: 13065 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatcaaatttcacctattgaaattgcttctcagctcccaacaactaaccctgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 13066 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 13067 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13068 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13069 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagatcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13070 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13071 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctattgaaattgcttctcagctcccaacaactaaccctgatgcatcagttatgttggaccgaatgttgcgtctcttggcttgttacaatatcctcacttgttcagttcgtactcaacaagatggaaagattcagagactttatggtttggctactgttgctaa

SEQ ID NO: 13072 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctattgaaattgcttctcagctcccaacaactaaccctgatgcaccagttattttggaccgaatgttgcgtctcttggcttgttacaatatcctcacttgttcagttcgtactcaacaagatggaaaggttcagagactttatggtttggctactgttgctaa

SEQ ID NO: 13073 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13074 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13075 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13076 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagattttatggtttggctactgttgctaa

SEQ ID NO: 13077 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttga

SEQ ID NO: 13078 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatggaaagattcagagcctttatggtttggctactgttgctaa

SEQ ID NO: 13079 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgggctactgttgctaa

SEQ ID NO: 13080 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13081 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 13082 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13083 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13084 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13085 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctattgaaattgctcctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13086 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13087 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagtgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13088 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagtgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13089 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagtgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13090 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13091 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13092 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13093 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggatctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13094 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcatctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13095 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctgttcaaattgcttctcagcttccaacagctaaccctgatgcaccagtcatgttggaccgaatgttgcggctcttggcttgttacaatatcctcacttgttctgttcgtactcaacaagatggaaaggttcagagactttatggtttggctactgttgctaa

SEQ ID NO: 13096 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13097 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13098 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13099 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13100 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13101 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13102 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattggaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13103 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13104 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattgaaattgcttctcagctcccaacaactaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 13105 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13106 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13107 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggcctgttgctaa

SEQ ID NO: 13108 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctctgttgctaa

SEQ ID NO: 13109 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtcctcaacaagatggaaagattcagagactttatggtttggctactgttgctaa

SEQ ID NO: 13110 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13111 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattgaaattgcttctcagctaccaacaactaaccctgatgcaccagttatgttggactgaatgttgcgtctcttggcttgttacaatatcctcacttgttcagttcgtactcaacaagatggaaaggttcagagactttatggtttggctactgttgctaa

SEQ ID NO: 13112 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13113 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13114 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13115 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagacgttatggtttggctactgttgctaa

SEQ ID NO: 13116 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgtgcagttcatactcaacaagatggaaaggttcagagactttatggtttggctatgttgctaa

SEQ ID NO: 13117 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 13118 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13119 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13120 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactggacctggtgctcaaatttcacctgttcaaattgcttctcagcttccaacaactaaccctgatgcaccagtcatgttggaccgaatgttgcgtctcttggcttgttacaatatcctcacttgatcagttcgtactcaacaagatggaaaggttcagagactttatggtttggctactgttgctaa

SEQ ID NO: 13121 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13122 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13123 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13124 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactggacctggtgctcaaatttcacctattgaaattgcttctcagctcccaacaactaaccctgatgcaccagttatgttggaccgaatgttgcgtctcttggcttgttataatatcctcacttgttcagttcgtactcaacaagatggaaaggttcagagactttatggtttggctactgttgctaa

SEQ ID NO: 13125 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgctaa

SEQ ID NO: 13126 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13127 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13128 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13129 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13130 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13131 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactaaagctggacctggtgctcaaatttcacctattggaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13132 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13133 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13134 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13135 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13136 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactaaagctggacctggtgctcaaatttcacctattgaaattgcttctcagctcccaacaactaaccctgatgcaccagttatgttggaccgaatgttgcgtctcttggcatgttacaatatcctcacttgttcagttcgtcctcaacaagatggaaagattcagagactttatggtttggctactgttgctaa

SEQ ID NO: 13137 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 13138 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13139 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13140 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagatggaaaggttcagagactttatggtttggctactgttgctaa

SEQ ID NO: 13141 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactaaagctggacctggtgctcaaatttcacctattgaaattgcttctcagctaccaacaactaaccctgatgcaccagttatgttggacctaatgtttcgtctcttggcttgttacaatatcctcacttgttcagttcgtactcaacaagatggaaaggttcagagactttatggtttggctactgttgctaa

SEQ ID NO: 13142 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13143 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactaaagctggacctggtgctcaaatttcacctattgaaattgcttctcagctaccaacaactaaccctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 13144 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13145 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13146 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13147 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13148 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13149 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagacataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13150 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13151 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13152 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagacataaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13153 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13154 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatttcccgactggaaagcgggcagtgagcgcaacgcaattaatacgcgtaccgctagccagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13155 - DNA, 335 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatttcacctattgaaattgcttctcggctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13156 - DNA, 335 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13157 - DNA, 335 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13158 - DNA, 335 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13159 - DNA, 335 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13160 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13161 - DNA, 455 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattgctggcgatggccaccacctgctggggggtcaagccgtgggcctggcacagcaccggcaacagccgctggaccgtctccagcgcctgcttgccactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13162 - DNA, 455 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattgctggcgatggccaccacctgctggggggtcaagccgtgggcctggcacagcaccggcaacagccgctggaccgtctccagcgcctgcttgccactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13163 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13164 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13165 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctgttcaaattgcttctcagcttccaacaactaaccctgatgcaccagtcatgttggaccgaatgttgcgtctcttggcttgttacaatatcctcacttgtccagttcgtactcaacaagatggaaaggttcagagactttatggtttggctactgttgctaa

SEQ ID NO: 13166 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13167 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13168 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13169 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcactcgttcagttcgtactcaacaagatggaaagattcagagactttatggtttggctactgttgctaa

SEQ ID NO: 13170 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctattgaaattgcttctcagctcccaacaactaaccctgatgcaccagttatgttggaccgaatgatgcgtctcttggcttgttacaatatcctcacttgttcagttcgtactcaacaagatggaaaggttcagagactttatggtttggctactgttgctaa

SEQ ID NO: 13171 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 13172 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacagtatcctcacttgttcagttcgtactcaacaagatggaaagattcagagactttatggtttggctactgttgctaa

SEQ ID NO: 13173 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcaattgttcagttcgtactcaacaagatggaaaggttcagagactttatggtttggctactgttgctaa

SEQ ID NO: 13174 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13175 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13176 - DNA, 398 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatgtccagcggctgttgccggtgctgtgccaggcccacggctaaagctggacctggtgctcaaatttcacctattgaaattgcttctcagctcccaaccactaaccgtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13177 - DNA, 398 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatgtccagcggctgttgccggtgctgtgccaggcccacggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13178 - DNA, 398 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatgtccagcggctgttgccggtgctgtgccaggcccacggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13179 - DNA, 398 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatgtccagcggctgttgccggtgctgtgccaggcccacggctaaagctggaactggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 13180 - DNA, 399 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatgtccagcgcctgcttgccggtgctgtgccaggcccacggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13181 - DNA, 399 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatgtccagcgcctgcttgccggtgctgtgccaggcccacggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13182 - DNA, 399 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatgtccagcgcctgcttgccggtgctgtgccaggcccacggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13183 - DNA, 399 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatgtccagcgcctgcttgccggtgctgtgccaggcccacggctaaagctggacctggtgctcaaatttcacctattgaaattgattctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13184 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 13185 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 13186 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13187 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13188 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatggtgctcaaatttcacctattgaaattgcttctcagctcccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 13189 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 13190 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13191 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13192 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 13193 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13194 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13195 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13196 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13197 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13198 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13199 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13200 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13201 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13202 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatctaaagctggacctggtgctcaaatttcacctattgaaattgcttctcagctcccaacaactaatcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13203 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13204 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatctaaagctggacctggtgctcaaatttcacctattgaaattgcttctcagctaccaacaactaaccctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 13205 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcctaacgcttgacctgctgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13206 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13207 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13208 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcctaaagctggacctggtgctcaaatttcacctgttcaaattgcttctcagcttccaacaactaaccctgatgcaccagtcatgttggaccgaatgttgcgtctcttggcttgttacaatatcctcccttgttcagttcgtactcaacaagatggaaagattcagagactttatggtttggctactgttgctaa

SEQ ID NO: 13209 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggcgactgttgctaa

SEQ ID NO: 13210 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13211 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13212 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13213 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13214 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13215 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgttctcaacaagatggaaaggttcagagactttatggtttggctactgttgctaa

SEQ ID NO: 13216 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactttgctaa

SEQ ID NO: 13217 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13218 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcctaaagctggacctggtgctcaaatttcacctattgaaattgcttctcagctaccaacaactaaccctgatgcaccagttatgttggaccgagtgtagcgtctcttggcttgttacaatatcctcacttgttcagttcgtactcaacaagatggaaaagttcagagactttatggtttggctactgttgctaa

SEQ ID NO: 13219 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13220 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcctaaagctggacctggggctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13221 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcattgctaaagctggacctggtgcttaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 13222 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13223 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13224 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcatgctggacctggtgctcaaatttcacctattgaaattgcttctcagctcccaacaactaaccctgatgcaccagttatgttggaccgaatgttgcgtctcttggcttgttacaatatcatcacttgttcagttcgtactcaacaagatggaaagattcagagactttatggtttggctactgttgctaa

SEQ ID NO: 13225 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13226 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagacgttatggtttggctactgttgctaa

SEQ ID NO: 13227 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13228 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13229 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcatgctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13230 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13231 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13232 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13233 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13234 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13235 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcataaagctggacctggtgctcaaatttcacctgttcaaattgcttctcagcttccaacaactaaccctgatgcaccagtcatgttggaccgaatgttgcgtctcttggcttgttacaatatcctcacatgttctgttcgtactcaacaagatggaaaggttcagagactttatggtttggctactgttgctaa

SEQ ID NO: 13236 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcataaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13237 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13238 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13239 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13240 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13241 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13242 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13243 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13244 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggatctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13245 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaagtttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13246 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaattttacctgttcaaattgctttccagcttccaacaactaaccctgatgcaccattaattttggcccgaatttggcgtcccttggcttgttacaatatcctcctttgttcattccttctccacaaagatggaaagattcagagcctttatggtttgctactgttgctaa

SEQ ID NO: 13247 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaggttcagagactttatggtttggctactgttgctaa

SEQ ID NO: 13248 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13249 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13250 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13251 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 13252 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13253 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 13254 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13255 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 13256 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctgttcaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13257 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13258 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctgttcaaatcgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13259 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13260 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctccgctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13261 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13262 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactaaacaagatggaaaggttcagagactttatggtttggctactgttgctaa

SEQ ID NO: 13263 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13264 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13265 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 13266 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttctgttcgtattcaacaagatggaaaggttcagagactttatggtttgctactgttgctaa

SEQ ID NO: 13267 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatcttgcgtctcttggcttgttacaatatcctcacttgttcagttcgtactcaacaagatggaaaggttcagagactttatggtttggctactgttgctaa

SEQ ID NO: 13268 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgtgcagttcgtactcaacaagatggaaaagttcagagactttatggtttggctactgttgctaa

SEQ ID NO: 13269 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtcgcttggcttgttacaatatcctcacttgttcagttcgtactcaacaagatggaaagattcagagactttatggtttggctactgttgctaa

SEQ ID NO: 13270 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttactaa

SEQ ID NO: 13271 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 13272 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgaaaagattcagagactttatggtttggctactgttgctaa

SEQ ID NO: 13273 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcctactcaacaagatggaaaagttcagagactttatggtttggctactgttgctaa

SEQ ID NO: 13274 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagattgaaagattcagagactttattgtttggctactgttgctaa

SEQ ID NO: 13275 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 13276 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 13277 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggactgaatgttgcgtctcttggcttgttacaatatcctcacttgttcagttcgtactcaacaagatggaaagattcagagactttatggtttggctactgttgctaa

SEQ ID NO: 13278 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13279 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggctcgttacaatatcctcacttgttcagttcgtactcaacaagatggaaaggttcagagactttatggtttggctactgttgctaa

SEQ ID NO: 13280 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 13281 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13282 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13283 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13284 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatattgcgtctcttggcttgttacaatatcctcacttgttcagttcgtactcaacaagatggaaaggttcagagactttatggtttggctactgttgctaa

SEQ ID NO: 13285 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 13286 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgtgctaa

SEQ ID NO: 13287 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 13288 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13289 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 13290 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctagtgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13291 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaattccacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13292 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13293 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13294 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagtctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13295 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagtctaaagctggacctggtgctcaaatttcacctattgaaattgcttctcagctaccaacaactaaccctgatgcaccagttatgttggaccgaatgttgcgtctctttgcttgttacaatatcctcacttgttcagttcgtactcaacaagatggaaagattcagagactttatggtttggctactgttgctaa

SEQ ID NO: 13296 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagtaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13297 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagtaaagctggacctggtgctcaaatttcacctattgatattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13298 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13299 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13300 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13301 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagtaaagctggacctggtgctcaaatttcacctattgaaattgcttctcagctcccaacaactaaccctgatgcaccagttatgttgaaccgaatgttgcgtctcttggcttgttacaatatcctcacttgttcagttcgtactcaacaagatggaaaggttcagagactttatggtttggctactgttgctaa

SEQ ID NO: 13302 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagtaaagctggacctggtgctcaaatttcacctattgaaattgcttctcagctaccaacaactaaccctgttgcaccagttatgttgtaccgaatgttgcgtctcttggcttgttacaatatcctcacttgttcagttcgtattcaacaagatagaaaagttcagagactttattgtttggcgactgttgctaa

SEQ ID NO: 13303 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13304 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13305 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 13306 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagcttccaacaactaaccctgatgcaccagttatgttggaccgaatgttgcgtctcttggcttgttacaatatcctcacttgttcagttcgtaatcaacaagatggaaagattctgagactttatggtttggtactgttgctaa

SEQ ID NO: 13307 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13308 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13309 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13310 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13311 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 13312 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 13313 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 13314 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagcttccaacaactaaccctgatgcaccagtcatgttggaccgaatgttgcgtctcttggcttgttacaatatccccacttgttctgttcgtactcaacaagatggaaaggttcagagactttatggtttggctactgttgctaa

SEQ ID NO: 13315 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagcttccaacaactaaccctgatgcaccagtcatgttggaccgaatgttgcggctcttggcttgttacaatttcctcacttgttctgttcgtactcaacaagatggaaaggttcagagactttatggtttggctactgttgctaa

SEQ ID NO: 13316 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13317 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13318 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13319 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13320 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13321 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13322 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 13323 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacgactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13324 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaaccactaaccctgatgcaccagttatgttggaccgaatgttgcggcacttggcttgttacaatatcctcacttgttcagttcgtactcaacaagatggaaaggttcagagactttatggtttggctactgtggcgaa

SEQ ID NO: 13325 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaacccttatgcaccagttatgttggaccgaatgttgcgtctcttggcttgttacaatatcctcacttgttcagttcgtactcaacaagatggaaagattcagagactttatggtttggctactgttgcaaa

SEQ ID NO: 13326 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13327 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13328 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13329 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaaaatggaaagattcagagactttatggtttggctactgttgctaa

SEQ ID NO: 13330 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13331 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggccactgttgctaa

SEQ ID NO: 13332 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 13333 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 13334 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgttaa

SEQ ID NO: 13335 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgaaaaggttcagagactttatggtttggctactgttgctaa

SEQ ID NO: 13336 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactttgctaa

SEQ ID NO: 13337 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcaa

SEQ ID NO: 13338 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtacccaacaagatggaaagattcagagactttatggtttggctactgttgctaa

SEQ ID NO: 13339 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacgagatggaaaggttcagagactttatggtttggctactgttgctaa

SEQ ID NO: 13340 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagtttgtactcaacaagatggaaaggttcagagactttatggtttggctactgttgctaa

SEQ ID NO: 13341 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttccaatatcctcgcttgttcagttcgtactcaacaagatggaaagattcagagactttatggtttggctactggtgctaa

SEQ ID NO: 13342 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13343 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcacagttatgttggaccgaatgttgcgtctcttggcttgttacaatatcctcacttgttcagttcgtactcaacaagatggaaaggttcagagactttatggtttggctactgttgctaa

SEQ ID NO: 13344 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaacctgatgcaccagttatgtcggaccgaatgttgcgtctcttggcttgttacaatatcctcacttgttcagttcgtactcaacaagatggaaagattcagagactttatggtttggctactgttgctaa

SEQ ID NO: 13345 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13346 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13347 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13348 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13349 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13350 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 13351 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgctacaatatcctcacttgttcagttcgtactcaacaagatggaaaggttcagagactttatggtttggctactgttgctaa

SEQ ID NO: 13352 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagatggaaaagttcagagactttatggtttggctactgttgctaa

SEQ ID NO: 13353 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 13354 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13355 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaagggttcagagactttatggtttggctactgttgctaa

SEQ ID NO: 13356 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttcgcttgttacaatatcctcccttgttcagttcgtactcaacaagatggaaaggttcagagactttatggtttggctactgttgctaa

SEQ ID NO: 13357 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 13358 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttattcagttcgtactcaacaagatggaaagattcagagactttatggtttggctactgttgctaa

SEQ ID NO: 13359 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttactaa

SEQ ID NO: 13360 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtcctcaacaagatggaaaggttcagagactttatggtttggctactgttgctaa

SEQ ID NO: 13361 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcatttcgtactcaacaagatggaaagattcagagactttatggtttggctactgttgctaa

SEQ ID NO: 13362 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 13363 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 13364 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13365 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagtcatgttggaccaaatgttgcgtctcttggcttgttacaatatcctcacttgttctgttcgtactcaacaagatggaaaggttcagagactttatggtttggctactgttgctaa

SEQ ID NO: 13366 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgctactcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13367 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctatggaaattgcttctcagctcccaacaactaaccctgatgccccagttatgttggaccgaatgttgcgtctcttggctggttacaatatcctcacttgttcagttcgtactcaacaggatggaaagattcagagactttatgggttggctactgttgctaa

SEQ ID NO: 13368 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatctcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13369 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctagacctggtgctcaaatttcacctattgaaattgcttctcagctcccaacaactaatcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13370 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctaatgctggacctggtgctcaaatttcacctattgaaattgcttctcagctaccaacaactaaccctgatgcaccagttatgttggaccgaatgttgcttctcttggcttgttacaatatcctcacttgttcagttcgtactcaacaagatggaaaggttcagagcctttatggtttggcactgttgctaa

SEQ ID NO: 13371 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13372 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13373 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 13374 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcactcgttcagttcgtactcaacaagatggaaaggttcagagactttatggtttggctactgttgctaa

SEQ ID NO: 13375 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacgatatcctcacttgttcagttcgtactcaacaagatggaaaggttcagagactttatggtttggctactgttgctaa

SEQ ID NO: 13376 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13377 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 13378 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13379 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgtgctaa

SEQ ID NO: 13380 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13381 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13382 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13383 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13384 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13385 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactggacctggtgctcaattttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13386 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13387 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13388 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13389 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13390 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13391 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactggacctggtgctcaaatttcacctattgaaattgcttctcagctaccaacaactacccctgatgcacctgttatgttggaccgaatgttgcgtctcttggcttgttacaatatcctcacttgttcagttcgtactcaacaagatggaaaagttcagagactttatggtttggctactgttgctaa

SEQ ID NO: 13392 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13393 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13394 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagtgcgtactcaacaagatggaaaggttcagagactttagggtttggctactgttgctaa

SEQ ID NO: 13395 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 13396 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 13397 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13398 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13399 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttaaggtttggctactgtggctaa

SEQ ID NO: 13400 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctgttcaaattgcttctcagcttccaacaactaaccctgacgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13401 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13402 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13403 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctatttaaattgcttctcagctaccaacaactaaccctgatgcaccagttatgttggaccgaatgttgcgtcacttggcttgttacaatatcctcacttgttcagttcgtactcaacaagatggaaatgttcagagactttatggtttggctactgttgctaa

SEQ ID NO: 13404 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcatctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 13405 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13406 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcgtgttacaatatcctcacttgttcagttcgtactcaacaagatggaaagattcagagactttatggtttggctactgttgctaa

SEQ ID NO: 13407 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13408 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13409 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13410 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggctagttacaatatcctcacttgttcagttcgtactcaacaagatggaaaggttcagagactttatggtatggctactgttgctaa

SEQ ID NO: 13411 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 13412 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 13413 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacttaacaagatggaaaggttcagagactttatggtttggctactgttgctaa

SEQ ID NO: 13414 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctcccaacaactaaccctgatgcaccagtcatgttggaccgaatgtttcgtctcttggcttgttacaatatcctcacttgttctgttcgtactcaacaagatggaaaggttcagagactttatggtttggctactgttgctaa

SEQ ID NO: 13415 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctaccaacaactaaccctgatgcacctgttatgttggaccgaatgttgcgtctcttggcttgttacaatatcctcacttgttcagttcgtactcaacaagatggaaaagttcagagactttatggtttggctactgttgctaa

SEQ ID NO: 13416 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13417 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13418 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13419 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcgcttgttcagttcgtactcaacaagatggaaaagttcagagactttatggtttggctactgttgctaa

SEQ ID NO: 13420 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13421 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13422 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctactgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 13423 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13424 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13425 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaacattaaagctgtacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13426 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaacattaaagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaagattcagagactttatggtttggctactgttgctaa

SEQ ID NO: 13427 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaacattaaagctggacctggtgctcaaatttcacctattgaaattgcttctcagctcccaacaactaaccctgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 13428 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaacattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13429 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaacattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtcctcaacaagatggaaagattcagagcctttatggtttggctactgttgctaa

SEQ ID NO: 13430 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaacattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 13431 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaacattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13432 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaacattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13433 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaacattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13434 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgaa

SEQ ID NO: 13435 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13436 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13437 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13438 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctacttttgctaa

SEQ ID NO: 13439 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattttagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 13440 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13441 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13442 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttgcacaagataaaaatatatcatcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13443 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttgacggatggccttctgcttagtttgatgcctggcagtttatggcgggcgtcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13444 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacttggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13445 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13446 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13447 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13448 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctgttcaaattgcttctcagcttccaacaactaaccctgatgcaccagtcatgttggaccgaatgttgcgtctcttggcttgttataatatcctcacttgttctgttcgtactcaacaagatggaaaggttcagagactttatggtttggctactgttgctaa

SEQ ID NO: 13449 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13450 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagcctttatggtttggctactgttgctaa

SEQ ID NO: 13451 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctgtgcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 13452 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13453 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13454 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtgctcaacaagatggaaaggttcagagactttatggtttggctactgttgctaa

SEQ ID NO: 13455 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgtcacaatatcctcacttgttcagttcgtactcaacaagatggaaagattcagagactttatggtttggctactgttgctaa

SEQ ID NO: 13456 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13457 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 13458 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13459 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctaccaacatctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13460 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13461 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13462 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagcgactttatggtttggctactgttgctaa

SEQ ID NO: 13463 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13464 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13465 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattggacctggtgctcaaatttcacctattgaaattgcttctcagttcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13466 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13467 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13468 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13469 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13470 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 13471 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13472 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattggacctggtgctcaaatttcacctattgaaattgcttctcagctcccaacaactaaccctgatgcaccagttatgttggaccgaattttgccgcccttggcttttttaaaatatctccctttttcaggttcttctcaaaaaaaatgaaaagtttaggaaccttatggtttggctactgttgctaa

SEQ ID NO: 13473 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattggacctggtgctcaaatttcacctattgaaattgcttctcagctcccaacaactaaccctgatgcaccagttatgttgaaccgaatgttgcatcacatggcttgttgcaatatcctcacatgttcagttagtactcaacaagatagaaaagttcggagactttatggtttggctactgttgctaa

SEQ ID NO: 13474 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13475 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 13476 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13477 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaataagatggaaagattcagagactttatggtttggctactgttgctaa

SEQ ID NO: 13478 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13479 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattgctaaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13480 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattgctaaatggacctggtgctcaaatttcacctattgaaattgcttctcagctaccaacaactaaccctgatgcaccagttatgttggaccgaattttgcgtctctttgcttgttacaatatcctcacttgttcatttcgtactcaacaagatggaaaatttcagagactttatggtttggctactgttgctaa

SEQ ID NO: 13481 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattgctaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13482 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattgctaaatggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 13483 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13484 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13485 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattgaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13486 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattgaacctggtgctcaaatttcacctattgaaattgcttctcagctcccaacaactaaccctgatgcaccagttatgttggaccgaatgttgcgtctcttggcttgttacaatagcctcacttgttcagttcgtactcaacaagatggaaaggttcagagactttatggtttggctactgttgctaa

SEQ ID NO: 13487 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattgaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13488 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattctggttctcaaatttcacctattgaaattgcttctcagctcccaacaactaaccctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 13489 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13490 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13491 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13492 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13493 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13494 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattctggtgatcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13495 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13496 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13497 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13498 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattctggacctggagctcaaatctcacctattgaaattgcttctcagctcccaacaactaaccctgatgcaccagttatgttggaccgtatgtttcatccctagacttgataaaatatcctcacttgttcagttcgtaatcaacaatatggaaaggctcagagactttatggtttggctactgttgctaa

SEQ ID NO: 13499 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattctccagcgcctgttgccggtgctgtgccaggcccacggcttgaccccccagcaggtggtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13500 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13501 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13502 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13503 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13504 - DNA, 387 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattccgactgagcctttcgttttatttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13505 - DNA, 387 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattccgactgagcctttcgttttatttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13506 - DNA, 387 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattccgactgagcctttcgttttatttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctaatgttgctaa

SEQ ID NO: 13507 - DNA, 435 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattccagcggctgttgccggtgctgtgccaggcccacggcttgaccccggagcaggtggtggccatcgccagccacgatggcggcaagcaggcgctggaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13508 - DNA, 435 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattccagcggctgttgccggtgctgtgccaggcccacggcttgaccccggagcaggtggtggccatcgccagccacgatggcggcaagcaggcgctggaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13509 - DNA, 435 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattccagcggctgttgccggtgctgtgccaggcccacggcttgaccccggagcaggtggtggccatcgccagccacgatggcggcaagcaggcgctggaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13510 - DNA, 387 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattccaactgagcctttcgttttatttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13511 - DNA, 310 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13512 - DNA, 310 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13513 - DNA, 310 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13514 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13515 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13516 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13517 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13518 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13519 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13520 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctattgaaattgcttctcagctcccaacaactaaccctgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 13521 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctattgaaattgcttctcagctcccaacaactaaccctgatgcaccagttatgttggaccgaatgttgcgtctcttggcttgttacaatatcctcacttgttcagttagtactcaacaagatggaaaggttcagagactttatggtttggctactgttgctaa

SEQ ID NO: 13522 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13523 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13524 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13525 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13526 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13527 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttaggcttcagattgctaa

SEQ ID NO: 13528 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13529 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaacgctggacctggtgctcaaatttcacctattgagattgcttctcagctcccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13530 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaacgctggacctggtgctcaaatttcacctattgaaattgcttctcagctcccaacaactaaccctgatgcaccagttatgttggaccgaatgttgcgtcgcttggcttgttacagtatcctcacttgttgagttcgtactcaacaggagggaaagattcagggccgtgggggtttggggactggtgctaa

SEQ ID NO: 13531 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaacgctggacctggagctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13532 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagttggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctctgttgctaa

SEQ ID NO: 13533 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13534 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13535 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaaggtggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13536 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctgtacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13537 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctgtacctggtgctcaaatttcacctattgaaattgcttctcagctcccaacagctaaccctgatgcaccagttatgtttgaccgaatgttgcgtctcttggcttgttacaatatcctcacttgttcagttcgtactcaacaagatggaaagattcagagactttatggtttggctactgttgctaa

SEQ ID NO: 13538 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctgtacctggtactcaaatttcacctattgagattgcttctcagctaccaacaactaaccctgatgcaccagttatgttggaccgaatgttgtgtctcttggcttgttacaatttcctcacttgttcagttcgttctcaacaagatggaaaagttcagagactttatggtttggatactgttgctaa

SEQ ID NO: 13539 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggaccttgtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 13540 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctgttgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13541 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgttcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13542 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgttcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13543 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagcttccaacaactaaccctgatgcacctgttatgttggaccgaatgttgcgtctcttggcttgttacaatatcctcacttgttcagttcgtactcaacaagatggaaaggttcagagactttatggtttggctactgttgctaa

SEQ ID NO: 13544 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13545 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13546 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13547 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13548 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactggtgctaa

SEQ ID NO: 13549 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 13550 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 13551 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttcttttcgtactcaacaagatggaaaggttcagagactttatggtttggctactgttgctaa

SEQ ID NO: 13552 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 13553 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgtgctgttcgtactcaacaagatggaaaggttcagagactttatggtttggctactgttgctaa

SEQ ID NO: 13554 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13555 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13556 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13557 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13558 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctatttaaattgcttctcagctcccaacaactaaccctgattcaccagttatgttggaccgaatgttgcgtctcttggcttgttacaatatcctcacttgttcagtgcgtactcaacaagatggaaaggttcagagactttatggtttggctactgttgataa

SEQ ID NO: 13559 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggctactgtgctaa

SEQ ID NO: 13560 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcaaagactttatggtttggctactgttgctaa

SEQ ID NO: 13561 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 13562 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcctaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13563 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcctaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13564 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccagcaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13565 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccagcaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13566 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactagccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13567 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctggtgcaccagttatgttggaccgaatgttgcgtctcttggcttgttacaatatcctcacttgttcagttcgtactcaacaagatggaaagattcagagactttatggtttggctactgttgctaa

SEQ ID NO: 13568 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgctccagttatgttggaccgaatgttgcgtctcttggcttgttacaatatcctcacttgttcagttcgtactcaacaagatggaaagattcagagactttatggtttggctactgttgctaa

SEQ ID NO: 13569 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgtttgaccgaatgttgcgtctcttggcttgttacaatatcctcacttgttcagttcgtactcaacaagatggaaaggttcagagactttatggtttggctactgttgctaa

SEQ ID NO: 13570 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13571 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13572 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtgtggctactgttgctaa

SEQ ID NO: 13573 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggtttagagactttatggtttggctactgttgctaa

SEQ ID NO: 13574 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcttgttgctaa

SEQ ID NO: 13575 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13576 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 13577 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagctcgtactcaacaagatggaaaggttcagagactttatggtttggctactgttgctaa

SEQ ID NO: 13578 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 13579 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 13580 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatagaaaggttcagagactttatggtttggctactgttgctaa

SEQ ID NO: 13581 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 13582 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 13583 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattccgagactttatggtttggctactgttgctaa

SEQ ID NO: 13584 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcatttcgtactcaacaagatggaaatattcagagactttatggtttggctactgttgctaa

SEQ ID NO: 13585 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgtaacaatatcctcacttgttcagttcgtactcaccaagatggaaaggttcagagcctttatggttggctactgttgctaa

SEQ ID NO: 13586 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13587 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcacttcgtactcaacaagatggaaaggttcagagactttatggtttggctactgttgctaa

SEQ ID NO: 13588 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 13589 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttagctactgttgctaa

SEQ ID NO: 13590 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtttcttggcttgttacaatatcctcacttgttcagttcgtactcaacaagatggaaagattcagagactttatggtttggctactgttgctaa

SEQ ID NO: 13591 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttacggtttggctactgttgctaa

SEQ ID NO: 13592 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgcactcaacaagatggaaagattcagagactttatggttggctactgttgctaa

SEQ ID NO: 13593 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgtctactgttgctaa

SEQ ID NO: 13594 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcactgttgctaa

SEQ ID NO: 13595 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaaaaagatggaaagattcagagactttatggtttggctactgttgctaa

SEQ ID NO: 13596 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctacagttgctaa

SEQ ID NO: 13597 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 13598 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 13599 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatgtcctcacttgttcagttcgtactcaacaagatggaaaggttcagagactttatggtttggctactgtagctaa

SEQ ID NO: 13600 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactttgctaa

SEQ ID NO: 13601 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgcctcttggcttgttacaatatcctcacttgttcagttcgtactcaacaagatggaaaggttcagagactttatggtttggctactgttgctaa

SEQ ID NO: 13602 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtgtcttggcttgttacaatatcctcacttgttcagttcgtactcaacaagatggaaagattcagagactttatggtttggctactggtgctaa

SEQ ID NO: 13603 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggacctaatgttgcatctcttggcttgttacagtatcctcacttgttctgttcgtactcaacaagatggaaaggttcagagtctttatggtttggctactgtggctaa

SEQ ID NO: 13604 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgagtctcttggcttgttacaatatcctcacttgttcagttcgtactcaacaagatggaaaggttcagagactttatggtttggctactgttgctaa

SEQ ID NO: 13605 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagtccgtactcaacaagatggaaagattcagagactttatggtttggctactgttgctaa

SEQ ID NO: 13606 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtcacttggcttgttacaatatcctcacttgttcagttcgtactcaacaagatggaaagattcagagactttatggtttggctactgtggctaa

SEQ ID NO: 13607 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgggtctcttggcttgttacaatatcctcacttgttcagttcgtactcaacaagatggaaaggttcagagactttatggtttggctactgttgctaa

SEQ ID NO: 13608 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 13609 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 13610 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgttaa

SEQ ID NO: 13611 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggtaagattcagagactttatggtttggctactgttgctaa

SEQ ID NO: 13612 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 13613 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaagattcagagactttatggtttggctactgttgctaa

SEQ ID NO: 13614 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcaattcgtactcaacaagatggaaagattcagagactttatggtttggctactgttgctaa

SEQ ID NO: 13615 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagaaggaaagattcagagactttatggtttggctactgttgctaa

SEQ ID NO: 13616 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttagggtttggctactgttgctaa

SEQ ID NO: 13617 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 13618 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtcctcaacaagatggaaagattcagagactttatggtttggctactgttgctaa

SEQ ID NO: 13619 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaataacctcacttgttcagttcgtactcaacaagatggaaaggttcagagactttatggtttggctactgttgctaa

SEQ ID NO: 13620 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 13621 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgtttagttcgtactcaacaagatggaaagattcagagactttatggtttggctactgttgctaa

SEQ ID NO: 13622 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagtacgtactcaacaagatggaaaggttcagagactttatggtttggctactgttgctaa

SEQ ID NO: 13623 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgccaa

SEQ ID NO: 13624 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggatcgaatgttgcgtctcttggcttgttacaatatcctcacttgttcagttcgtactcaacaagatggaaagattcagagactttatggtttggctactgttgctaa

SEQ ID NO: 13625 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgtaa

SEQ ID NO: 13626 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacgtgttcagttcgtactcaacaagatggaaagattcagagactttatggtttggctactgttgctaa

SEQ ID NO: 13627 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgctggaccgaatgttgcgtctcttggcttgttacaatatcctcacttgttcagttcgtactcaacaagatggaaaggttcagagactttatggtttggctactgttgctaa

SEQ ID NO: 13628 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13629 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 13630 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 13631 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaacagttatgttggaccgaatgttgcgtctcttggcttgttacaatatcctcacttgttcagttcgtactcaacaagatggaaaggttcagagactttatggtttggctactgttgctaa

SEQ ID NO: 13632 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgacgcaccagttatgttggaccgaatgttgcgtctcttggcttgttacaatatcctcacttgttcagttcgtactcaacaagatggaaagattcagagactttatggtttggctactgttgctaa

SEQ ID NO: 13633 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13634 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13635 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaacctgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 13636 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13637 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaccaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13638 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacatctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13639 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13640 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13641 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13642 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13643 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggctttttacaatatcctcactttttcagttcgttcccaaccagatggaaaagttcagagactttatggtttggctactgttgctaa

SEQ ID NO: 13644 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggttactgttgctaa

SEQ ID NO: 13645 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcttactcaacaagatggaaaggttcagagactttatggtttggctactgttgctaa

SEQ ID NO: 13646 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 13647 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggctcgttacaatatcctcacttgttcagttcgtactcaacaagatggaaaggttcagagactttatggtttggctactgttgctaa

SEQ ID NO: 13648 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatgggttggctactgttgctaa

SEQ ID NO: 13649 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgaaaaggttcagagactttatgggttggctactgttgctaa

SEQ ID NO: 13650 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgtgctaa

SEQ ID NO: 13651 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctacgttgctaa

SEQ ID NO: 13652 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatccacttgttcagttcgtactcaacaagatggaaaggttcagagactttatggtttggctactgttgctaa

SEQ ID NO: 13653 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgtgcagttcgtactcaacaagatggaaagattcagagactttatggtttggctactgttgctaa

SEQ ID NO: 13654 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 13655 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactttgctaa

SEQ ID NO: 13656 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctaccgttgctaa

SEQ ID NO: 13657 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgtagcgtctcttggcttgttacaatatcctcacttgttcagttcgtactcaacaagatggaaaggttcagagactttatggtttggctactggtgctaa

SEQ ID NO: 13658 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagctcgtactcaacaagatggaaagattcagagactttatggtttggctactgttgctaa

SEQ ID NO: 13659 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagtccagagactttatggtttggctactgttgctaa

SEQ ID NO: 13660 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 13661 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctattggcttgttacaatatcctcacttgttcagttcgtactcaacaagatggaaaggttcagagactttatggtttggctactgttgctaa

SEQ ID NO: 13662 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 13663 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13664 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcaactaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13665 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttcgcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 13666 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgctcctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13667 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgattctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13668 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctaccgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13669 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacatattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13670 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaattccacctattgaaattgcttctcagctcccaacaactaaccctgatgcaccagttatgttgtaccgaatttttcgtctcttggcttgttacaatatcctcacttgttcagttcgttctcaacaagatggaaaggttcagagactttatggtttggctactgttgctaa

SEQ ID NO: 13671 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13672 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgatcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13673 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13674 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13675 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctcgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13676 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctgcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13677 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagccggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13678 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagatggacctggtgctcaaatttcacctatttaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13679 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13680 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13681 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13682 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13683 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgtaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13684 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgtaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 13685 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgtaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13686 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgtaaagctggacctggtgctcaaatttcacctgttcaaattgcctctcagcttccaacaactaaccctgatgcaccattcatgttggaccgaatgttgcgtctcttggcttgttacaatatcctcacttgttctgttcgtactcaacaagatggaaaggttcagagactttatggtttggctactgttgctaa

SEQ ID NO: 13687 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13688 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13689 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13690 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggtgctcaaatttcacctattgaaattgcttctcagctcccaacaactaaccctgatgcaccagttatgttggaccgaatgttgcgtctcttggcttgttacaatatcctcacttgttcagtccgtactcaacaagatggaaagattcagagactttatggtttggctactgttgctaa

SEQ ID NO: 13691 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggtgctcaaatttcacctattgaaattgcttctcagctcccaacaactaaccctgatgcaccagttatggtggaccgaatgttgcgtctcttggcttgttacaatatcctcacttgttcagttcgtactcaacaagatggaaaggttcagagactttatggtttggctactgttgctaa

SEQ ID NO: 13692 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13693 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13694 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13695 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13696 - DNA, 478 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgggcctggcacagcaccggcaacagccgctggaccgtctccagcgcctgcttgccaccgccattgctggcgatggccaccacctgctggggggtcaagccgtgggcctggcacagcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13697 - DNA, 478 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgggcctggcacagcaccggcaacagccgctggaccgtctccagcgcctgcttgccaccattattgctggcgatggccaccacctgctggggggtcaagccgtgggcctggcacagcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13698 - DNA, 478 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgggcctggcacagcaccggcaacagccgctggaccgtctccagcgcctgcttgccaccattattgctggcgatggccaccaccggctggggggtcaagccgtgggcctggcacagcattaaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 13699 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13700 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggacctggtgctcaaatttcacctattgaaattgcttctcagctcccagcaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13701 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13702 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13703 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13704 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaaagttcagagactttatggtttggctactgttgctaa

SEQ ID NO: 13705 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13706 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13707 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 13708 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13709 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13710 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctggacctggtgctcaaatttcatctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13711 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13712 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13713 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 13714 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13715 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctggacctggtgctcaaatttcacctattgaaattgcttctcagctcccaacaactaaccctgatgcaccagttatgttggaccgaatgttgcgtctcctggcttgttacaatatcctcacttgttcagttcgtactcaacaagatggaaaagttcagagactttatggtttggctactgttgctaa

SEQ ID NO: 13716 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13717 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13718 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctaaagctggacctggttctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13719 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13720 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13721 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13722 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctaaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatggaaagattcagagactttatggtttggctactgttgctaa

SEQ ID NO: 13723 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgggctactgttgctaa

SEQ ID NO: 13724 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctaaagctggacctggtgctcaaatttcacctattgaaattgcttctcagctcccaacaactaaccctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 13725 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13726 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13727 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13728 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13729 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgacctggtgctcaaatttcacctattgaaattgcttctcagctcccaacaactaaccctgatgcaccagttatgttggaccaatgttgcgtctcttggcttgttacaatatcctcacttgttcagttcgtactcaacaagatggaaaggttcagagactttatggtttggctactgttgctaa

SEQ ID NO: 13730 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13731 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13732 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13733 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13734 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13735 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcttgctaaagctggacctggtgctaaaatttcacctattgaaattgcttctcagctcccaacaactaaccctgatgcaccagttatgttggaccgaatgttgcgtctcttggcttgttacaaaatcctcacttgttcagttcgtactcaacaagatggaaagattcagagactttatggtttggctactgttgctaa

SEQ ID NO: 13736 - DNA, 319 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13737 - DNA, 319 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13738 - DNA, 319 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13739 - DNA, 319 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 13740 - DNA, 319 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcttctcagctaccaacaactaaccctgatccaccagttatgttggaccgaatgttgcgtctcttggcttgttacaatatcctcacttgttcagttcgtactcaacaagatggaaaggttcagagactttatggtttggctactgttgctaa

SEQ ID NO: 13741 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcttaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13742 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 13743 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13744 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13745 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13746 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcttaaagctggacctggtgctcaaatttcacctattgaaattgcttctcagctaccaacaactaaccctgatgcaccagttatgttggaccgaatgttgcatctcttggcttgttacaatatcctcacttgttcagttcgtactcaacaagatggaaagattcagagactttatggtttggctactgttgctaa

SEQ ID NO: 13747 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13748 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggtgttcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggttggctactgttgctaa

SEQ ID NO: 13749 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13750 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13751 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggtgctcaaatttcacctattgaaattgcttctcagctcccaacaactaaccctgatgcaccagttatgttggaccgaatgttgcgtctcttggcttgttacaatatcctcacttgttcagttcgtacttaacaagatggaaagattcagagactttatggtttggctactgttgctaa

SEQ ID NO: 13752 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13753 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13754 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggtgctcaaatttcacctattgaaattgcttctcagctaccaacaactaaccctgatgcaccagttatgttggaccgaatgttgcgtctcttggcttgttacaataacctcacttgttcagttcgtactcaacaagatggaaaggttcagagactttatggtttggctactgttgctaa

SEQ ID NO: 13755 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13756 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 13757 - DNA, 397 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggcggtggccaccacctgctggggggtcaagccgctaaagctggacctggtgctcaaatttcacctattgaaattgcttctcagctcccaacaactagccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13758 - DNA, 397 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggcggtggccaccacctgctggggggtcaagccgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13759 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggccctggtgctcaaatttcacctattgaaattgcttctcagctcccaacaactaaccctgatgcaccagttatgttggaccgaatgttgcgtctcttggcttgttacaatatcctcacttgttcagtccgtactcaacaagatggaaaggttcagagactttatggtttggctacgttgctaa

SEQ ID NO: 13760 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13761 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13762 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13763 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13764 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgtgctaa

SEQ ID NO: 13765 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13766 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 13767 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 13768 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 13769 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgccaa

SEQ ID NO: 13770 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgcaa

SEQ ID NO: 13771 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13772 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 13773 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13774 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctgttcaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13775 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13776 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13777 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagcttccaacaactatccctgatgcaccagttatgttggaccgaatgttgcgtctcttggcttgttacaatatcctcacttgttcatttcgttctcaacaagatggaaagattcagagactttatggtttggctactgttgctaa

SEQ ID NO: 13778 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13779 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 13780 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13781 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgtatgttgcgtctcttggcttgttacaatatcctcacttgttcagttcgtactcaacaagatggaaaagttcagagactttatggtttggctactgttgctaa

SEQ ID NO: 13782 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 13783 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13784 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13785 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13786 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcttcacttgttcagttcgtactcaacaagatggaaagattcagagactttatggtttggctactgttgctaa

SEQ ID NO: 13787 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 13788 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctctgggcttgttacaatatcctcacttgttcagttcgtactcaacaagatggaaagattcagagactttatggtttggctactgttgctaa

SEQ ID NO: 13789 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 13790 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 13791 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 13792 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtaatcaacaagatggaaagattcagagactttatggtttggctactttgctaa

SEQ ID NO: 13793 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctgctgttgctaa

SEQ ID NO: 13794 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggttttgctactgttgctaa

SEQ ID NO: 13795 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatattggaccgaatgttgcgtctcttggcttgttacaatatcctcacttgttcagttcgtactcaacaagatggaaaggttcagagactttatggtttggctactgttgctaa

SEQ ID NO: 13796 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13797 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13798 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13799 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 13800 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13801 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaagttcagagactttatggtttggctactgttgctaa

SEQ ID NO: 13802 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaacatggaaaggttcagagactttatggtttggctactgttgctaa

SEQ ID NO: 13803 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13804 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13805 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcaccgattgaaattgcttctcagctcccaacaactaaccctgatgcaccagttatgttggaccgaatgttgcgtctcttggcttgttacaatatcctcacttgtgcagttcgtactcaacaagatggaaagattcagagactttatggtttggctactgttgcgaa

SEQ ID NO: 13806 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13807 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtcctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13808 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctgctggacctggtgctcaaatttcacctattgaaattgcttctcagctcccaacaactaaccctgatgcaccagttatgttggaccgaatgttgcgtctcttggcttgttacaatatcctcacttgtttagttcgtactcaacaagatggaaagattcagagactttatggtttggctactgttgctaa

SEQ ID NO: 13809 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13810 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagacgttatggtttggctactgttgctaa

SEQ ID NO: 13811 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtagctaa

SEQ ID NO: 13812 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13813 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctgctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13814 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13815 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13816 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctgaacctgatgctcaaatttcaccaattgaaattgcttctcagttcctaccaactaacccggaagcaccattcatgttggacggaatgttgcgtcacttggctggttacaatatcctcacttgttcagttcttactcaccaaaatgaaaagattcagggactttatggtttggttatgttgctaa

SEQ ID NO: 13817 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13818 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13819 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13820 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13821 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13822 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctctaaagctggacctggtgctcaaatttcacctatttaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13823 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13824 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13825 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13826 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13827 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctccagcgccggcctgccgccgccattgccatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13828 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctccagcgccggcctgccgccgccattgccatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13829 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctatagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 13830 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctatagctggacctgatgctcaaatttcacctactgaaattgcatcgcagctaccaacaactaaccctgatgcaccagttatgttggaccgaatgtcgcgtctcttcgactgttacaatatccacacttgttcagttcgttctaaacaagatggaaaggtgcacagattttaaggtttggctactgttgctaa

SEQ ID NO: 13831 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13832 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13833 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctacagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13834 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13835 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 13836 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaagctggacctggtgctcaaatttcacctattgaaattgcttctcatctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13837 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaagctggacctggtgctcaaatttcacctattgaaattgcttctcagctcccgacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13838 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13839 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactgaacaagatggaaagattcagagactttatggtttggctactgttgctaa

SEQ ID NO: 13840 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13841 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13842 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13843 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13844 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13845 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaacgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13846 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13847 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggttctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13848 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgttcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13849 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtggtcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13850 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcgaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13851 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13852 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13853 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccattcatgttggaccgaatgttgcgtctcttggcttgttacaatatcctcacttgttaagttcgtactcaacaagatggaaaggttcagagactttatggtttggctactgttgctaa

SEQ ID NO: 13854 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13855 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13856 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13857 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagttatgttggaccgaatgttgcgtctcttggcttgttacaatatcctcacttattcagttcgtactcaacaagatggaaaggttcagagactttatggtttggctactgttgctaa

SEQ ID NO: 13858 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13859 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacgagatggaaaggttcagagactttatggtttggctactgttgctaa

SEQ ID NO: 13860 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagttatgttggtccgaatgttgcgtcgcttggcttgttacaatatcctcacttgttcagttcgtactcaacaagatggaaaagttcagagactttatggtttggctactgttgctaa

SEQ ID NO: 13861 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13862 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggacccaatgttgcgtctcttggcttgttacaatatcctcacttgttctgttcgtactcaacaagatggaaaggttcagagactttatggtttggctactgttgctaa

SEQ ID NO: 13863 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggtttgttacaatatcctcacttgttctgttcgtactcaacaagatggaaaggttcagagactttatggtttggctactgttgctaa

SEQ ID NO: 13864 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 13865 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13866 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 13867 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacagtatcctcacttgttctgttcgtactcaacaagatggaaaggttcagagactttatggtttggctactgttgctaa

SEQ ID NO: 13868 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagcctttatggtttggctactgttgctaa

SEQ ID NO: 13869 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagcctttatggtttggctactgttgctaa

SEQ ID NO: 13870 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13871 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13872 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13873 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13874 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13875 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgatattgcttctcagctcccaacaactaaccctgatgcaccagttatgttggaccgaatgttgcgtctcttggcttgttacaatatcctcacttgttcagttcgtactcaagatggaaagattcagagactttatggtttggctactgttgctaa

SEQ ID NO: 13876 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgagattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13877 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgagattgcttctcagctaccaacaactaaccctgatgcaccagttatgttggaccgaatgttgcgtctcttggcttgttacaatatcctcacttgttcagttcgtactcagcaagatggaaaggttcagagactttagggtttggctactgttgctaa

SEQ ID NO: 13878 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttcttagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13879 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctctgctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13880 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13881 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13882 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13883 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13884 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctatgttgctaa

SEQ ID NO: 13885 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13886 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagcttccaacaactaaccctgatgcaccagtcatgttggaccgaatgttgcgtctcttggcttgttacaatatcctcactttttcagttcgtactcaacaagatggaaaagttcagagactttatggtttggctactgttgctaa

SEQ ID NO: 13887 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13888 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacacctaaccctgaggcaccagttattttggaccgaatgttgcgcctctgggctggttacaaaatcctcacttgttcagttcgtcctcaccaagatggaaaggtccagagcctttagggtttgctactgttgctaa

SEQ ID NO: 13889 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactgaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13890 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaacccttgtgcacccgttatgtttgaccgaattttgcggtccctgggctgttacaatatcctcacttgttcagttcgtactcaacaagatggaaaggttcagagactttatggtttggctactgttgctaa

SEQ ID NO: 13891 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgttgcaccagttatgttggaccgaatgttgcgtctcttggcttgttacaatatcctcacttgttcagttcgtactcaacaagatggaaaggttcagagactttatggtttggctactgttgctaa

SEQ ID NO: 13892 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgattcaccagttatgttggaccgaatgttgcgtctcttggcttgttacaatatcctcacttgttcagttcgtactcaacaagatggaaaggttcagagactttatggtttggctactgttgctaa

SEQ ID NO: 13893 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 13894 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13895 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13896 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 13897 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgggtactgttgctaa

SEQ ID NO: 13898 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagaccttatggtttggctactgttgctaa

SEQ ID NO: 13899 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13900 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 13901 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctag

SEQ ID NO: 13902 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgtttcgtctcttggcttgttacaatatcctcacttgttcagttcgtactcaacaagatggaaaggttcagagactttatggtttggctactgttgctaa

SEQ ID NO: 13903 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgtaaaggttcagagactttatggtttggctactgttgctaa

SEQ ID NO: 13904 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13905 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 13906 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgc

SEQ ID NO: 13907 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacgagatggaaagattcagagactttatggtttggctactgttgctaa

SEQ ID NO: 13908 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacgatatcctcacttgttcagttcgtactcaacaagatggaaaggttcagagactgtatggtttggctactgttgctaa

SEQ ID NO: 13909 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaaggtggaaagattcagagactttatggtttggctactgttgctaa

SEQ ID NO: 13910 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgtaa

SEQ ID NO: 13911 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 13912 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 13913 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatgtcctcacttgttcagttcgtactcaacaagatggaaagattcagagactttatggtttggctactgttgctaa

SEQ ID NO: 13914 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacctgttcagttcgtactcaacaagatggaaaagttcagagactttatggtttggctactgttgctaa

SEQ ID NO: 13915 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctacttttgctaa

SEQ ID NO: 13916 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcactttttcggttcgtcctcaacaagatggaaaggttcagagactttatggtttggctacggttgctaa

SEQ ID NO: 13917 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 13918 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 13919 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttttggtttggctactgttgctaa

SEQ ID NO: 13920 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 13921 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggactgaatgttgcgtctcttggcttgttacaatatcctcacttgttcagttcgtactcaacaagatggaaagattcagagactttatggtttggctactgttgctaa

SEQ ID NO: 13922 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttattgtttggctactgatgctaa

SEQ ID NO: 13923 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggatactgttgctaa

SEQ ID NO: 13924 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggattgttacagtatcctcacttgttcagttcgtactcaacaagatggaaaagttcagagactttatggtttggctactgttgctaa

SEQ ID NO: 13925 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggccactgttgctaa

SEQ ID NO: 13926 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 13927 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatggtgcgtctcttggcttgttacaatatcctcacttgttcagttcgtactcaacaagatggaaagattcagagactttatggtttggcgactgttgctaa

SEQ ID NO: 13928 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttgtggtttggctactgttgctaa

SEQ ID NO: 13929 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 13930 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 13931 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttactaa

SEQ ID NO: 13932 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcactttttcagttcgtactcaacaagatggaaagattcagagcctttatcgtttggctactgttgctaa

SEQ ID NO: 13933 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 13934 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtcgctaa

SEQ ID NO: 13935 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcggctcttggcttgttacaatatcctcacttgttcagttcgtactcaacaagatggaaaggttcagagactttatggtttggctactgttgctaa

SEQ ID NO: 13936 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagatcgtactcaacaagatggaaagattcagagactttatggtttggctactgttgctaa

SEQ ID NO: 13937 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaaggttcagagactttatggtttggctactgtcgctaa

SEQ ID NO: 13938 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtcgcttggcttgttacaatatcctcacttgttcagttcgtactcaacaagatggaaagattcagagactttatggtttggctactgttgctaa

SEQ ID NO: 13939 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttattacaatatcctcacttgttcagttcgtactcaacaagatggaaagattcagagactttatggtttggctactgttgctaa

SEQ ID NO: 13940 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatacctcacttgttcagttcgtactcaacaagatggaaagattcagagactttatggtttggctactgttgctaa

SEQ ID NO: 13941 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatccccacttgttcagttcgtactcaacaagatggaaagattcagagactttatggtttggctactgttgctaa

SEQ ID NO: 13942 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtgctcaacaagatggaaagattcagagactttatggtttggctactgttgctaa

SEQ ID NO: 13943 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 13944 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgttctcaacaagatggaaagattcagagactttatggtttggctactgttgctaa

SEQ ID NO: 13945 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcactcgttcagttcgtactcaacaagatggaaaggttcagagactttatggtttggctactgttgctaa

SEQ ID NO: 13946 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 13947 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaaccagatggaaaggttcagagactttatggtttggctactgttgctaa

SEQ ID NO: 13948 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 13949 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcaa

SEQ ID NO: 13950 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttcgaccgaatgttgcgtctcttggcttgttacaatatcctcacttgttcagttcgtactcaacaagatggaaaggttcagagactttatggtttggctactgttgctaa

SEQ ID NO: 13951 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13952 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13953 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgaaccagttatgttggaccgaatgttgcgtctcttggcttgttacaatatcctcacttgttcagttcgtactcaacaagatggaaagattcagagactttatggtttggctactgttgctaa

SEQ ID NO: 13954 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13955 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaacgaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 13956 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctacctacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13957 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaagttcagagactttatggtttggctactgttgctaa

SEQ ID NO: 13958 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcactagttatgttggaccgaatgttgcgtctcttggcttgttacaatatcctcacttgttcagttcgtactcaacaagatggaaaggttcagagactttatggtttggctactgttgctaa

SEQ ID NO: 13959 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttgtaccgaatgttgcgtctcttggcttgttacaatatcctcgcttgttcagttcgtactcaacaagatggaaaggttcagagactttatggtttggctactgttgctaa

SEQ ID NO: 13960 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 13961 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13962 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 13963 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 13964 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgtaa

SEQ ID NO: 13965 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 13966 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtgtggctactgttgctaa

SEQ ID NO: 13967 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctacgttgctaa

SEQ ID NO: 13968 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtcacttggcttgttaaaatatcctcacttgttcagttcgtactcaacaagatggaaaagttcagagactttatggtttggctactggtgataa

SEQ ID NO: 13969 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtcgcttggcttgttacaatatcctcacttgttcagttcgtactcagcaagatgtatatgttcagagactttatggtttggctactgttgctaa

SEQ ID NO: 13970 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtcacttggcttgttacaatatcctcacttgttcagttcgtactcaacaagatggaaaagttcagagactttatggtttggctactgttgctaa

SEQ ID NO: 13971 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagacattatggtttggctactgttgctaa

SEQ ID NO: 13972 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgctgcaa

SEQ ID NO: 13973 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcgtgttacaatatcctcacttgttcagttcgtactcaacaagatggaaaggttcagagactttatggtttggctactgttgctaa

SEQ ID NO: 13974 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttagggtttggctattgttgctaa

SEQ ID NO: 13975 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttgagagactttatggtttggctactgttgctaa

SEQ ID NO: 13976 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 13977 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcctgttacaatatcctcacttgttcagttcgtactcaacaagatggaaaagttcagagactttatggtttggctactgttgctaa

SEQ ID NO: 13978 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacgcaacaagatggaaaggttcagagactttatggtttggctactgttgctaa

SEQ ID NO: 13979 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtcgcttggcttgttacaatatcctcacttgttcagttcgtactcaacaagattgaatggttcagagactttatggtttggctactgttgctaa

SEQ ID NO: 13980 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttagggtttggctactgtctaa

SEQ ID NO: 13981 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggctcgttacaatatcctcacttgttcagttcgtactcaacaagatggaaaggttcagagactttatggtttggctactgttgctaa

SEQ ID NO: 13982 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcactgttgcta

SEQ ID NO: 13983 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggctcagagactttatggtttggctactgttgctaa

SEQ ID NO: 13984 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcatactcaacaagatggaaaagttcagagactttatggtttggctactgttgctaa

SEQ ID NO: 13985 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcttactcaacaagatggaaagattcagagactttatggtttggctactgttgctaa

SEQ ID NO: 13986 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 13987 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 13988 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgtgacaatatcctcacttgttcagttcgtactcaacaagatggaaaggttcagagactttatggtttggctactgttgctaa

SEQ ID NO: 13989 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttgaccgaatgttgcgtctcttggcttgttacaatatcctcacttgttcagttcgtactcaacaagatggaaaggttcagagactttatggtttggctactgttgctaa

SEQ ID NO: 13990 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 13991 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttacgttggaccgaatgttgcgtctcttggcttgttacaatatcctcacttgttcagttcgtactcaacaagatggaaaggttcagagactttatggtttggctactgttgctaa

SEQ ID NO: 13992 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 13993 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 13994 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagtatgttggaccgaatgttgcgtctcttggcttgttacaatatcctcacttgttcagttcgtactcaacaagatggaaaggttcagagactttatggtttggctactgttgctaa

SEQ ID NO: 13995 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccaattatgttggaccgaatgttgcgtcacgtggcttgttacaagatcctcacttgttgagttcgtcctcaacaagatggataggttcagagaccatatggtttggctaccgttgcgaa

SEQ ID NO: 13996 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 13997 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13998 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 13999 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcaactcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14000 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttcccagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14001 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14002 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaattacacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14003 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaacttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14004 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaaattcacctattgaaattgcttctcatctcccaacaactaaccctgatgcaccagttatgttggaccgaatgttgcgtctcttggcttgttacaatatcctcacttgttcagttcgtactcaacaagatggaaaggttcaaagactttatggtttggctactgttgctaa

SEQ ID NO: 14005 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgcccaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14006 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14007 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14008 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14009 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggcggtcaaatttcacctattggaattgcttctcagctcccaacaacgaaccctgatgcaccaggtatgtggggacgaatgttgcgtctcttgggttggtacaatatcctcacttggtctggtcgttctcaacaagatggaaagggtcaggggctttaaggtttggctactgttgctaa

SEQ ID NO: 14010 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggagctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14011 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggagctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14012 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14013 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14014 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14015 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggaactggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14016 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagccggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14017 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgttggtagctcttgatccggcaaacaaaccaccgctggtagcggtggtttttttgtttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14018 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgttggtagctcttgatccggcaaacaaaccaccgctggtagcggtggtttttttgtttgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14019 - DNA, 413 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgtggggcacgtacttcagcttgtgcctcaactcggatttcttctcctccagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14020 - DNA, 413 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgtggggcacgtacttcagcttgtgcctcaactcggatttcttctcctccagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14021 - DNA, 413 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgtggggcacgtacttcagcttgtgcctcaactcggatttcttctcctccagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14022 - DNA, 413 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgtggggcacgtacttcagcttgtgcctcaactcggatttcttctcctccagctaaagctggacctggtgctcaaatttcacctattgaaattgcttctcagctcccaacaactacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14023 - DNA, 412 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgtggggcacgtacttcagcttgtgcctcaactcggatttcttctcctccagctaaagctgacctggtgctcaaatttcacctctttttttttcttctcttctgccctcctctggccctgattctcccgtttttttggtccgattgttgcgtctcttggcttgttccaatatcctcacttgttcagttcgtactcaacaagatggaaagcttccccgactttatggtttggctactgttgctga

SEQ ID NO: 14024 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14025 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14026 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttagggtgtggctactgttgctaa

SEQ ID NO: 14027 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgtgctcaaatttcacctattgaaattgcttctcagctaccaacaactaaccctgatgcaccagttatgttggaccgaatgttgcgtctcttggcttgttacaatatcctcacttgttcagttcgtactcaaccagatggaaaggttcagagactttatggtttggctactgttgctaa

SEQ ID NO: 14028 - DNA, 476 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgtccagcgcctgcttgccaccgccattgctggcgatggccaccacctgctggggggtcaagccgtgggcctggcacagcaccggcaacagccgctggaccgtctccagcgcctgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14029 - DNA, 476 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgtccagcgcctgcttgccaccgccattgctggcgatggccaccacctgctggggggtcaagccgtgggcctggcacagcaccggcaacagccgctggaccgtctccagcgcctgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14030 - DNA, 451 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcggccgacgggcaggttgtagccgccggagtaggccttggtgtccacgatcacgccgtagtcgatgggggagcccacggtgtagatggcgccgtcgggcttcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14031 - DNA, 451 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcggccgacgggcaggttgtagccgccggagtaggccttggtgtccacgatcacgccgtagtcgatgggggagcccacggtgtagatggcgccgtcgggcttcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14032 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14033 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcacccgttatgttggacccaatgttgcgtctcttggcttgttacaataacctcacttgttcagttcgtactcaacaagatggaaaggttcagagactttatggtttggctactgttgctaa

SEQ ID NO: 14034 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggacctaatgttgcgtctcttggcttgttacaatatcctcacttgttcagttcgtactcaacaagatggaaagattcagagactttatggtttggctactgttgctaa

SEQ ID NO: 14035 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14036 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagacactttatggtttggctactgttgcaa

SEQ ID NO: 14037 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggattgtgacaatatcctcacttgttcagttcgttctcaacaatatggaaaggttcagagactttatggtttggctactgttgctaa

SEQ ID NO: 14038 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14039 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14040 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 14041 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 14042 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgctaa

SEQ ID NO: 14043 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 14044 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 14045 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 14046 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14047 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14048 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14049 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14050 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcagcaagatggaaaggttcagagactttatggtttggctactgttgctaa

SEQ ID NO: 14051 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14052 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14053 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14054 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14055 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14056 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 14057 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14058 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctaaagctggacctggtgctcaaatttcacctattgaaattgcttctcagctaccaacaactaaccctgatgcaccagttatgctggatcgaatgttgcgtctcttggcttgttacaatatcctcacttgttcagttcgtactcaacaagatggaaaggttcagagactttatggtttggctactgttgctaa

SEQ ID NO: 14059 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14060 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14061 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14062 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggcactgttgctaa

SEQ ID NO: 14063 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14064 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14065 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14066 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14067 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14068 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14069 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14070 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14071 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14072 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgaagctggacctggtgctcaaatttcacctattgaaattgcttctcagctcccaacaactaaccctgatgcaccagttatgttggaccgaatgttgcgtctcttggcttgttacaatatccacacttgttcagttcgtactcaacaagatggaaaggttcagagactttatggtttggctactgttgctaa

SEQ ID NO: 14073 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14074 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14075 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14076 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgaagctggacctggtgctaaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14077 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatccttgctggacctggtgctcaaatttcacctattgaaattgcttctcagctaccaacaactaaccctgatgcaccagttatgttggaccgaatgttgcgtctcttgggttgttacaatatcctcacgtgttcagttcgtactcaacaagatggaaaggttcagagactttatggtttggctactgttgctaa

SEQ ID NO: 14078 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14079 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14080 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14081 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcccatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14082 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14083 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14084 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14085 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14086 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14087 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14088 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14089 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagcttcagagactttatggtttggctactgttgctaa

SEQ ID NO: 14090 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14091 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14092 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14093 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttgtggtttggctactgttgctaa

SEQ ID NO: 14094 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctctgttgctaa

SEQ ID NO: 14095 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctatagaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14096 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttgacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14097 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14098 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14099 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctgttcaaattgcttctcagcttccaacaactaaccctgatgcaccagttatggtggaccgaatgttgcgtctcttggcttgttgcaatatcctcacttgttcagttcgtactcaacaagatggaaagattcagagactgtatggttgggctactgttgctaa

SEQ ID NO: 14100 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14101 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14102 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14103 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctgttcaaattgcttctcagcttccaacaactaaccctgatgcaccagtcatgttggaccgaatgttgcgtctcttggcttgttacaataccctcacttgttcttttcgtactcaacaagatggaaaggttcagagactttatggtttggctactgttgctaa

SEQ ID NO: 14104 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14105 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14106 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctgttcaaattgcttctcagctaccaacaactaaccctgattcaccagttatgttggaccgaatgttgcgtctcttggcttgttacaatatcctcacttgttcagttcgtactcaacaagacggaaaagttcagagactttatggtttggctactgttgctaa

SEQ ID NO: 14107 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14108 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14109 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattggttctcagctcccaacaactaaccctgatgcaccagttatgttggaccgaatgttgcgtctctttgcttgttacaatatcctcacttgttcagttcgtactcaacaagatggaaagattcagagactttatggtttggctactgttgctaa

SEQ ID NO: 14110 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14111 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttattttggaccgaatgttgcgtctcttggcttgttacaatatcctcacttgttcagttcgtactcaacaagatggaaagattcagagactttatggtttggctactgttgctaa

SEQ ID NO: 14112 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14113 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14114 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14115 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaaggtggaaaggttcagagactttatggtttggctactgttgctaa

SEQ ID NO: 14116 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcgactgttgctaa

SEQ ID NO: 14117 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttcgctactgttgctaa

SEQ ID NO: 14118 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgtggcgtctcttggcttgttacaatatcctcacttgttcagttcgtactcaacaagatggaaagattcagagactttatggtttggctactgttgctaa

SEQ ID NO: 14119 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatggtggaccgaatgttgcgtctcttggcttgttacaatatcctcacttgttcagttcgtactcaacaagatggaaagattcagagactttatggtttggctactgttgctaa

SEQ ID NO: 14120 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14121 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14122 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14123 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14124 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14125 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgaa

SEQ ID NO: 14126 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 14127 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14128 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14129 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatccgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14130 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatccgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14131 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatccaccctccgggccgttgcttcacaacgttcaaatccgccgggagcggatttgaacgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14132 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatccaccctccgggccgttgcttcacaacgttcaaatccgccgggagcggatttgaacgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcatagactttatggtttggctactgttgctaa

SEQ ID NO: 14133 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatccaccctccgggccgttgcttcacaacgttcaaatccgccgggagcggatttgaacgctaaagctggacctggtgctcaaatttcacctattgaaattgcttctcagctcccaacaactgaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14134 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatccaccacctgctggggggtcaagccgtgggcctggcacagcaccggcaacagccgctggaccgtctccagcgcctgcttgccgccatcgtggctgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14135 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatccaccacctgctggggggtcaagccgtgggcctggcacagcaccggcaacagccgctggaccgtctccagcgcctgcttgccgccatcgtggctgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14136 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatccaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14137 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatccaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14138 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatccaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14139 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatccaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 14140 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatccaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14141 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14142 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14143 - DNA, 367 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14144 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14145 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 14146 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14147 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatttcacctgttcaaattgcttctcagcttccaacaactaaccctgatgcaccagtcatgttggaccgaatgttgcgtctcttggcttgttacaatatcctcacttgttctgttcgtactaaacaagatggaaaggttcagagactttattgtttggctactgttgctaa

SEQ ID NO: 14148 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14149 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14150 - DNA, 432 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatttacgccaacggttgaagtgccgatttgcggtcacgcgacagtagctgcgcactatgtacgtgcgaaggtgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14151 - DNA, 383 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgtgacgctcaagtcagaggtagagctggacctggtgctcaaatttcacctattgaaattgcttctcagctcccaacagctaaccctgatgcaccatttatgttggaccgaatgttgcgtctcttggcttgttacaatatcctcacttgttcagttcgtactcaacaagatggaaaagttcagagactttatggtttggctactgttgctaa

SEQ ID NO: 14152 - DNA, 383 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgtgacgctcaagtcagaggtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14153 - DNA, 383 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgtgacgctcaagtcagaggtaaagctggacctggtgctcaaatttcacctattgaaattgcttctcagctcccaacaactaaccctgatgcactagttatgttggaccgaatgttgcgtctcttggcttgttacaatatcctcacttgttcagttcgtactcaacaagatggaaagattcagagactttatggtttggctactgttgctaa

SEQ ID NO: 14154 - DNA, 383 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgtgacgctcaagtcagaggtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14155 - DNA, 383 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgtgacgctcaagtcagaggtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14156 - DNA, 383 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgtgacgctcaagtcagaggtaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14157 - DNA, 438 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgtaaaaaggccgcgttgctggcgtttttccataggctccctctggcaacgctgcgattatgtcctgatacttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14158 - DNA, 472 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggtggccatcgccagcaatggcggtggcaagcaggcgctggagacggtccagcggctgttgccggggctgtgccaggcccacggcttgaccccggagcaggtggtggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14159 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14160 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14161 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14162 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14163 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcgactgttgctaa

SEQ ID NO: 14164 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggtgctcaaatttcacctattgaaattgcttctcagctcccaacaactaaccctgatgcaccagttatgttggaccgaatgttgcgtctcttggtttgttacaatatcctcacttgttcagttcgtactcaacaagatggaaagattcagagactttatggtttggctactgttgctaa

SEQ ID NO: 14165 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggtgctcaaatttcacctattgaaattgcttctcagctcccaacaactaaccctgatgcaccagttatgttggaccgaatattgcgtctcttggcttgtttcaatatcctcacttgttcagttcgtactcaacaagatggaaaggttcagagactttatggtttggctactggtgctaa

SEQ ID NO: 14166 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14167 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14168 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14169 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactctatggtttggctactgttgctaa

SEQ ID NO: 14170 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgggcctggcacagcaccggcagcagccgctggaccgtctccagcgcctgcttgccgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14171 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaagtttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14172 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14173 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14174 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctgttcaaattgcttctcagcttccaacaactaaccctgatgcaccagtcatgttggaccgaaggttgcgtctctgggcgtgttacaatatcctcacttgttctgttcgtaatcaacaagatggaaaggttcagagcctttatggtttggata

SEQ ID NO: 14175 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttacggtttggctactgttgctaa

SEQ ID NO: 14176 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 14177 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14178 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14179 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 14180 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14181 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14182 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctgttcaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14183 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14184 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctattgaaattgcttctcagctcccaacaactaaccctgatgcaccatttatgttggacctaatgttgcgtctcttggcttgttacaatatcctcacttgttcagttcgtactcaacaagatggaaagattcacagactttatggtttgcctactgttgctaa

SEQ ID NO: 14185 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctattgaaattgcttctcagctcccaacaactaaccctgatgcaccagttatgttggtccgaatgttgcgtctcttggcttgttacaatatcctcacttgttctgttcgtcctcaaccatatggaaaggttcagagactttatggtttggctactgttgctaa

SEQ ID NO: 14186 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14187 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14188 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14189 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctattgaaattgcttctcagctcccaacaactaaccctgatgcaccagttatgttggaccgaatgttgcgtctcttggcttgttacattatcctcacttgttcagttcgtactcaacaagatggaaagattcagagactttatggtttggctactgttgctaa

SEQ ID NO: 14190 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14191 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14192 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14193 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14194 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggcgatggccaccacctgctccctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14195 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggcgatggccaccacctgctccctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14196 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggcgatggccaccacctgctccctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14197 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggagacggtccagcggctgttgccggtgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14198 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggagacggtccagcggctgttgccggtgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14199 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggagacggtccagcggctgttgccggtgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14200 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggagacggtccagcggctgttgccggtgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgtcgctaa

SEQ ID NO: 14201 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggagacggtccagcggctgttgccggtgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14202 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggagacggtccagcggctgttgccggtgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14203 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggagacggtccagcggctgttgccggtgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14204 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggagacggtccagcggctgttgccggtgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14205 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggagacggtccagcggctgttgccggtgctaaagctggacctggtgctcaaatttcacctattgaaattgcttctcagcgcccaacaactaaccctgatgcaccagttatgttggaccgaatgttgcgtctcttggcttgttacaatatcctcacttgttcagttcgtactcaacaagatggaaagattcagagactttatggtttggctactgtggctaa

SEQ ID NO: 14206 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14207 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14208 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14209 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggtacagagcctttatcgtttggatactgttgctaa

SEQ ID NO: 14210 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactctatggtttggctactgttgctaa

SEQ ID NO: 14211 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14212 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14213 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14214 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14215 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaagctggacctggtgctcaaatttcacctattgaaattgcttctcagctcccaacaactaaccctgatgcaccagttatgttggaccgaatgttgcgtctcttggcttgttataatatcctcacttgttcagttcgtactcaacaagatggaaagattcagagactttatggtttggctactgttgctaa

SEQ ID NO: 14216 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14217 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14218 - DNA, 403 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcctggcagtttatggcgggcgtccttcccgccccccccccggccgtgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14219 - DNA, 403 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcctggcagtttatggcgggcgtccttcccgccaccctccgggccgtgacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14220 - DNA, 403 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcctggcagtttatggcgggcgtccttcccgccaccctccgggccgtgacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14221 - DNA, 403 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcctggcagtttatggcgggcgtccttcccgccaccctcccggccgtgacctggtgctcaaatttcacctgttcaaattgcttctcagcttccaacaactaaccctgatgcaccagtcatgttggaccgaatgttgcgtctcttggcttgttacaatatcctcacttgttctgtttgtactcaacaagatggaaaggttcagagactttatggtttggctactgttgctaa

SEQ ID NO: 14222 - DNA, 403 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcctggcagtttatggcgggcgtcctgcccgccaccctccgggccgtgacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14223 - DNA, 403 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcctggcagtttatggcgggcgtcctccccgccaccctccgggccgtgacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14224 - DNA, 403 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcctggcagtttatggcgggcgtcctccccccccccctccgggccgtgacctggtgctcaaatttcacctgttcaaattgctgctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14225 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccgtgggcctggcacagcaccggcaacagcgcctgcaccgtctccagcgcttgctaaagctggacctggtgctcaaatttcacctattgaaattgcttctcagctcccaacaactaaccctgatgcaccagttatgttggaccgaatgttgcgcctcttggcttgttacaatatcctcacttgttcagttcgtactcaacaagatggaaaggttcagagactttatggtttggctactgttgctaa

SEQ ID NO: 14226 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccggagcaggtggtggccatcgccagccacgatggcggcaagcaggcgctggacctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14227 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccggagcaggtggtggccatcgccagccacgatggcggcaagcaggcgctggacctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14228 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccggagcaggtggtggccatcgccagccacgatggcggcaagcaggcgctggacctaaagctggacctggtgctcaaatttcacctattgaaattgcttctcagctaccaacaactatccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14229 - DNA, 472 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccggagcaggtggtggccatcgccagcaataatggtggcaagcaggcgctggagacggtccagcggctgttgccggctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14230 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccggagcaggtggtggccatcgccagcaacgatggcggcaagcaggcgctggacctaacgctggacctggtgctcaaatttcacctattgaaattgcttctcagctcccaacaactagccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14231 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccggagcaggtggtggccatcgccagcaacgatggcggcaagcaggcgctggacctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14232 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccggagcaggtggtggccatcgccagcaacgatggcggcaagcaggcgctggaccgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14233 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccggagcaggtggtggccatcgccagcaacgatggcggcaagcaggcgctggacctaaagctggacctggtgctcaaatttcacctattgaaattgcttctcagctcccaacaacgaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14234 - DNA, 472 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccccagcaggtggtggccatcgccagcaataatggtggcaagcaggcgctggagacggtccagcggctgttgccggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14235 - DNA, 472 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccccagcaggtggtggccatcgccagcaataatggtggcaagcaggcgctggagacggtccagcggctgttgccggctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14236 - DNA, 472 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccccagcaggtggtggccatcgccagcaataatggtggcaagcaggcgctggagacggtccagcggctgttgccggctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaaccagatggaaaggttcagagactttatggtttggctactgttgctaa

SEQ ID NO: 14237 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccccagcaggtggtggccataaagctggacctggtgctcaaatttcacctgttcaaattgcttctcagcttccaacaactaaccctgatgcaccagtcatgttggaccgaatgttgcgtctcttggctcgttacaatatcctcacttgttctgttcgtactcaacaagatggaaaggttcagagactttatggtttggctactgttgctaa

SEQ ID NO: 14238 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccccagcaggtggtggccataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14239 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccccagcaggtggtggccataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14240 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccccagcaggtggtggccataaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14241 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccccagcaggtggtggccataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14242 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccccagcaggtggtggccataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14243 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccccagcaggtggtggccataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14244 - DNA, 413 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccccagcaggtggtggccataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttgctactgttgctaa

SEQ ID NO: 14245 - DNA, 429 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccgccatcgtggctggcgatggccaccacctgctccggggtcaagccgtgggcccggcacaggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14246 - DNA, 406 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcccacggcttgaccccggagcaggtggtggccatcgccagctaaagctggacctggtgctcaaatttcacctgttcaaatttcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14247 - DNA, 406 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcccacggcttgaccccggagcaggtggtggccatcgccagctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14248 - DNA, 405 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcccacggcttgaccccggagcaggtggtggccatcgccagctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggcactgttgctaa

SEQ ID NO: 14249 - DNA, 406 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcccacggcttgaccccggagcaggtggtggccatcgccagctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14250 - DNA, 406 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcccacggcttgaccccggagcaggtggtggccatcgccagctaaagctggacctggtgctcaaatttcacctgttcaaattgcttctcagcttccaacaactaaccctgatgcaccagtcatgttggaccgaatgttgcgtctcttggcttgttacgatatcctcacttgttctgttcgtactcaacaagatggaaaggttcagagactttatggtttggctactgttgctaa

SEQ ID NO: 14251 - DNA, 406 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcccacggcttgaccccggagcaggtggtggccatcgccagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14252 - DNA, 406 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcccacggcttgaccccggagcaggtggtggccatcgccagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14253 - DNA, 458 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccagcaataatggtggcaagcaggcgctggagactgtccagcggctgttgccggtgctgtgccaggcccacggcttgaccccggagcaggtgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14254 - DNA, 458 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccagcaataatggtggcaagcaggcgctggagacggtccagcggctgttgccggtgctgtgccaggcccacggcttgaccccggagcaggtgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14255 - DNA, 458 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccagcaataatggtggcaagcaggcgctggagacggtccagcggctgttgccggtgctgtgccaggcccacggcttgaccccggagcaggtgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14256 - DNA, 458 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccagcaataatggtggcaagcaggcgctggagacggtccagcggctgttgccggtgctgtgccaggcccacggcttgaccccggagcaggtgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 14257 - DNA, 458 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccagcaataatggtggcaagcaggcgctggagacggtccagcggctgctgccggtgctgtgccaggcccacggcttgaccccggagcaggtgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14258 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccaccgccattgctggcgatggccaccacctgctggggggtcaagccgtgggcctggcacagcaccggcaacagccgctggacctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14259 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccaccgccattgctggcgatggccaccacctgctggggggtcaagccgtgggcctggcacagcaccggcaacagccgctggacctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14260 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccaccgccattgctggcgatggccaccacctgctggggggtcaagccgtgggcctggcacagcaccggcaacagccgctggacctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14261 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccaccgccattgctggcgatggccaccacctgctggggggtcaagccgtgggcctggcacagcaccggcaacagccgctggacctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14262 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccaccgccattgctggcgatggccaccacctgctggggggtcaagccgtgggcctggcacagcaccggcaacagccgctggacctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14263 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccaccgccattgctggcgatggccaccacctgctggggggtcaagccgtgggccgggcacagcaccggcaacagccgctggacctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14264 - DNA, 429 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcaacgcaattaatacgcgtaccgctagccaggaagagtttgtagaaacgcaaaaaggccatccgtaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14265 - DNA, 429 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcaacgcaattaatacgcgtaccgctagccaggaagagtttgtagaaacgcaaaaaggccatccgtaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14266 - DNA, 429 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcaacgcaattaatacgcgtaccactagccaggaagagtttgtagaaacgcaaaaaggccatccgtaaagctggacctggtgctcaaatttcacctgttcaaatttcttctcagcttccaacaactaaccctgatgcaccagtcatgttggaccgaatgttgcgtctcttggcttgttacaatatcctcactttttctgttcgtactcaacaagatggaaaggttcagagactttatggtttggctactgttgctaa

SEQ ID NO: 14267 - DNA, 423 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgagactctaattggataccgaggggaatttatggaacgtcagtggagcatttttgacgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14268 - DNA, 423 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgagactctaattggataccgaggggaatttatggaacgtcagtggagcatttttgacgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 14269 - DNA, 423 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgagactctaattggataccgaggggaatttatggaacgtcagtggagcatttttgacgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14270 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgaccgagttcaagttcctgttcgtgtccggcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14271 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgaccgagttcaagttcctgttcgtgtccggcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14272 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgaccgagttcaagttcctgttcgtgtccggcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14273 - DNA, 435 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgaccccggagcaggtggtggccatcgccagccacgatggcggcaagcaggcgctggagacggtccagcggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14274 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgaccccccagcaggtggtggccatcgtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14275 - DNA, 455 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgaccatgattacgaattcccgatctagtaggcctccagagcgcgtgcgccggaccactgtttgccgacgccaacgatcgcttcgtgtgtgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14276 - DNA, 454 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgaccatgattacgaattcccgatctagtaggcctccagagcgcgtgcgccggaccactgtttgccgacgccaacgatcgcttcgtgtgtgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 14277 - DNA, 455 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgaccatgattacgaattcccgatctagtaggcctccagagcgcgtgcgccggaccactgtttgccgacgccaacgatcgcttcgtgtgtgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14278 - DNA, 455 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgaccatgattacgaattcccgatctagtaggcctccagagcgcgtgcgccggaccactgtttgccgacgccaacgatcgcttcgtgtgtgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14279 - DNA, 455 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgaccatgattacgaattcccgatctagtaggcctccagagcgcgtgcgccggaccactgtttgccgacgccaacgatcgcttcgtgtgtgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14280 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14281 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14282 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattccacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14283 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14284 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14285 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14286 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14287 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 14288 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14289 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14290 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14291 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14292 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14293 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14294 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggaccttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14295 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgttcaaatttcacctattgaaattgcttctcagctcccaacaactaaccctgatgcaccagttatgttggaccgaatgttgcgtctcttggcttgttacaatatcctcgcttgttctgttcgtactcaacaagatggaaaggttcagagactttatggtttggctactgttgctaa

SEQ ID NO: 14296 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgcttaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14297 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttctcctattgaaattgcttctcagctcccaacaactaaccctgatgcaccagttatgttggaccgaatgttgcgtctcttggcttgttacaatatcctcacttgttcagttcgtactcaacaagatggaaaggttcagagactatatggtttggctactgttgctaa

SEQ ID NO: 14298 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14299 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctgttcaaattgcttctcagcttccaacaactaaccctgatgcaccagtcatgttggaccgaatgttgcgtctcttggcttgtgacaatatcctcacttgttcagttcgtactcaacaagagggaaagattcagagacgttatggtttggctactgttgctaa

SEQ ID NO: 14300 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgtctaa

SEQ ID NO: 14301 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14302 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14303 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagcttccaacaactaaccctgatgcaccagttatgttggaccgaatgttgcgtctcttggattgttacaatatcctcacttgttcagttcgtactcaacaagatggaaaggttcagagcctttatggtttggctactgttgctaa

SEQ ID NO: 14304 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14305 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14306 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14307 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctattggcttgttacaatatcctcacttgttcagttcgtactcaacaagatggaaaggttcagagactttagggtttggatactgttgctaa

SEQ ID NO: 14308 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaaggttgcggctcttggcttgttacaatatcctcacttgtgcagttggtactcaacaagattgaaaggttcagagactttatggtttgactactgtgcgaa

SEQ ID NO: 14309 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14310 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaaattcagagactttatggtttggctactgttgctaa

SEQ ID NO: 14311 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgtaggaccgaatgttgcgtctcttggcttgttacaatatcctcacttgttcagttcgtactcaacaagatggaaaggttcagagactttatggtttggctactgttgctaa

SEQ ID NO: 14312 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14313 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaacccggatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14314 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14315 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgtgcagttcgtactcaacaagatggaaaggttcagagactttatggtttggctactgttgctaa

SEQ ID NO: 14316 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14317 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacattatcctcacgtgttcagttcgtactcaacaagatggaaagattcagagactttatggtttggctactgttgctaa

SEQ ID NO: 14318 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14319 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 14320 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 14321 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14322 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcgtctcagctaccaacaactaaccctgatgcaccagttatgtgggaccgaatgttgcgtcgcttggcttgttacaatatcctcacttgttcagttcgtactcaacaagatggaaagattcagagactttatggtttggctactgttgctaa

SEQ ID NO: 14323 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14324 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggcgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14325 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14326 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14327 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14328 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14329 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggtgctcaaatttcacctgttcaaattgcttctcagcttccaacaactaaccctgatgcaccagtcatgttggaccgaatgttgcgtctcttggcttgttacaatatcctctcttgttcagttcgtaatcaacaagatggaaagattcagagactttatggtttggctactggtgctaa

SEQ ID NO: 14330 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14331 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14332 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14333 - DNA, 424 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgggtggcgggcaggacgcccgccataaactgccaggcatcaaactaagcagaaggccatccgaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14334 - DNA, 424 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgggtggcgggcaggacgcccgccataaactgccaggcatcaaactaagcagaaggccatccgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14335 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggcttgttatgactgtttttttgtggtacagtctatgcctcgggcatccaagcagcaagcgcgttacgccgtgggtcgatgtttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14336 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggcttgttatgactgtttttttggggtacagtctatgcctcgggcatccaagcagcaagcgcgttccgccgtgggtcgatgtttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14337 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggcttgttatgactgtttttttggggtacagtctatgcctcgggcatccaagcagcaagcgcgttacgccgtgggtcgatgtttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14338 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggcttgttatgactgtttttttggggtacagtctatgcctcgggcatccaagcagcaagcgcgttacgccgtgggtcgatgtttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14339 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggcttgttatgactgtttttttggggtacagtctatgcctcgggcatccaagcagcaagcgcgttacgccgtgggtcgatgtttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14340 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggcttgttatgactgtttttttggggtacagtctatgcctcgggcatccaagcagcaagcgcgttacgccgtgggtcgatgtttgctaaagctggacctggtgctcaaatttcacctattgaaattgcttctcagctcccaacaactagccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14341 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggcttgttatgactgtttttttggggtacagtctatgcctcgggcatccaagcagcaagcgcgttacgccgtgggtcgatgtttgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14342 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggcttgttatgactgtttttttggggtacagtctatgcctcgggcatccaagcagcaagcgcgttacgccgtgggtcgatgtttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14343 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggccatcgccagcaatggcggcggcaggccggcgctggagagcattgttgcccagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14344 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14345 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14346 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14347 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14348 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14349 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctgttcaaattgcatctcagcttccaacaactaaccctgatgcaccagttatgttggaccgaatgttgcgtctcttggcttgttacaatatcctcacttgttcagttcgtactcaacaagatggaaagattcagagactttgtggtttggctactgttgctaa

SEQ ID NO: 14350 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14351 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14352 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14353 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctattgaaattgcttctcagctcccaacaactaaccctgatgcaccagttatgttggaccgaatgttgcgtctcatggcttgttacaatatcctcacttgttcagttcgtactcaacaagatggaaaggttcagagactttatggtttggctactgttgctaa

SEQ ID NO: 14354 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttcagtttgtactcaacaagatggaaagattcagagactttatggtttggctactgttgctaa

SEQ ID NO: 14355 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14356 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14357 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14358 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 14359 - DNA, 398 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctggagacggtccagcggctgttgccggtgctgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14360 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14361 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14362 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctggacctggtgctcaaatttcacctattgaaattgcttctcagctcccaacaactaaccctgatgcaccagttatgttggaccgaatgttgcgtctcttggcttgttacaatatcctcacttgttcagttcgttctcaacaagatggaaaggttcagagcctttatggtttggctactgttgctaa

SEQ ID NO: 14363 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14364 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14365 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14366 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14367 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14368 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14369 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 14370 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14371 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 14372 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgtggctaa

SEQ ID NO: 14373 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14374 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14375 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14376 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctaaagctggacctggtgctcaaatttcacctattgaaattgcttctcagctcccaacaactaaccctgacgcaccagttatgttggaccgaatgttgtgtctcttggcttgttacaatatcctcacttgttcagttcgtactcaacaagatggaaagattcagagactttatggtttggctactgttgctaa

SEQ ID NO: 14377 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14378 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14379 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14380 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatgctaaagctggacctggtgcgcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14381 - DNA, 322 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcttctcagctcccaacaactaaccctgatgcaccagttatgttggaccgaatgttgcgtctcttggcttgttacaatatcctcccttgtttaattcgttcccaacaagatggaaaggttcagagaccttaaggtttggctactgttggtaa

SEQ ID NO: 14382 - DNA, 322 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14383 - DNA, 322 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14384 - DNA, 322 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcttctcagctcccaacaactaaccctgatgcaccagttatgttggaccgaatgatgcgtctcttggcttgttacaatatcctcacttgttcagttcgtactcaacaagatggaaagattcagagactttatggtttggctactgttgctaa

SEQ ID NO: 14385 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaattttacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14386 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctgttcaaattgcttctcagcttccaacaactaaccctgatgcactagtcatgttggaccgaatgttgcgtctcttggcttgttacaatatcctcacttgttctgttcgtactcaacaagatggaaaggttcagagactttatggtttggctactgttgctaa

SEQ ID NO: 14387 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14388 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttctaa

SEQ ID NO: 14389 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14390 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14391 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 14392 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggtccgattcttgcctctctaaacttgttaaaatatcctcactttttcagtttttactcatcaagaccgaaatactcagagactttatggtttggctaccgttgctaa

SEQ ID NO: 14393 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14394 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 14395 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14396 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14397 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14398 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcctggcttgttacaatatcctcacttgttcagttcgtactcaacaagatggaaagattcagagactttatggtttggctactgttgctaa

SEQ ID NO: 14399 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 14400 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgctacaatatcctcacttgttcagttcgtactcaacaagatggaaagattcagagactttatggtttggctactgttgctaa

SEQ ID NO: 14401 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcatcaagatggaaagattcagagactttatggtttggctactgttgctaa

SEQ ID NO: 14402 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14403 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaaccctgaagcaccagttatgttggaccgaatgttgcgtctcttggcttgttacaatatcctcacttgttcagttcgtactcaacaagatggaaaggttcagagactttatggtttggctactgttgctaa

SEQ ID NO: 14404 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatgtaaagattcagagactttatggtttggctactgttgctaa

SEQ ID NO: 14405 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctaccaacaactaaccctgatgcaccagttatgttgggccgaatgttgcgtctcttggcttgttacaatatcctcacttgttcagttcgtactcaacaagatggaaagattcagagactttatggtttggctactgttgctaa

SEQ ID NO: 14406 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14407 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14408 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14409 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcatttcgtcctcaacaagatggaaaggttcagagactttatggtttggctactgttgctaa

SEQ ID NO: 14410 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14411 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcgttgcgttaagccaacacccggcagcgtttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14412 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcgttgcgttaagccaacacccggcagcgtttaaagctggacctggtgctcaaatttcacctattgaaattgcttctcagctcccaacatctacccctgatgcaccagttatgttggaccgaatgttgcgtctcttggcttgttacaatatcctcacttgttcagttcgtactcaacaatatggaaaggttcagagactttatggtttggctactgttgctaa

SEQ ID NO: 14413 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcgttgcgttaagccaacacccggcagcgtttaaagctggacctggtgctcaaatttcacctattgaaattgcttctcagctcccaacaactagccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14414 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcgttgcgttaagccaacacccggcagcgtttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14415 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcggccaacgcgcggggagaggcggtctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 14416 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcggccaacgcgcggggagaggcggtctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14417 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcggccaacgcgcggggagaggcggtctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaatgttcagagactttatggtttggctactgttgctaa

SEQ ID NO: 14418 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcggccaacgcgcggggagaggcggtctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14419 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcggccaacgcgcggggagaggcggtctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14420 - DNA, 387 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatccagcgccggcctgccgccgccattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14421 - DNA, 366 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14422 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcagcgccggcctgccgccgccattgctggctaaagctggacctggtgctcaaatttcacctattgaaattgcttcttagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14423 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcagcgccggcctgccgccgccattgctggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14424 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcagcgccggcctgccgccgccattgctggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14425 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcagcgccggcctgccgccgccattgctggctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 14426 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcagcgccggcctgccgccgccattgctggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 14427 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcagcgccggcctgccgccgccattgctggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14428 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcagcgccggcctgccgcccacattgctggctaaagctggacctggtgctcaaatttcacctatttaaattgcttctcagctcccaacaactaaccctgatgcactagttatgttggatcgaatgttgcgtctcttggcttgttacaatatcctcacttgttcagttcatactcaacaagatggacaagttcagagactttatgggttggctactgttgctaa

SEQ ID NO: 14429 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcaagctggacctggtgctcaaatttcacctattgaaattgcttctcagctaccaacaactaaccctgatgcaccagttatgttggaccgaatgttgcgtctcttggcttgttacaatatcctcatttgttcagttcgtactcaacaagatggaaaggttcagagactttatggtttggctactgttgctaa

SEQ ID NO: 14430 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 14431 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14432 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14433 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14434 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttattgtttggctactgttgctaa

SEQ ID NO: 14435 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatagctggacctggtgctcaaatttcacctattgaaattgcttctcagctcccaacaactaaccctgatgcaccagttatgttggaccgaatgttgcgtctcttggcttgttacaatatcctcactagttcagttcgtactcaacaagatggaaaggttcagagactttatggtttggctactgttgctaa

SEQ ID NO: 14436 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatagctggacctggtgctcaaatttcacctattgaaattgcttctcagctcccaacaactaaccctgatgcaccagttatgttggaccgaatgttgcgtctcttggcttgttacaatatcctcacttgttctgttcatactcaacaagatggaaaggttcagagactttatggtttggctactgttgctaa

SEQ ID NO: 14437 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14438 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 14439 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatagctggacctggtgctcaaatttcacctattgaaattgcttctcagctaccaacaactaaccctgatgcaccagtgatgttggaccgaatgttgcgtctcttggcttgttacaatatcctcacttgttcagttcgtactcaacaagatggaaaggttcagagactttatggtttggctactgttgctaa

SEQ ID NO: 14440 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14441 - DNA, 402 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataatgctctccagcgccggcctgccgccgccattgctggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14442 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14443 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14444 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14445 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 14446 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 14447 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14448 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgtttctaa

SEQ ID NO: 14449 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14450 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14451 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14452 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14453 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14454 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcgactgttgctaa

SEQ ID NO: 14455 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctcccaacaactaaccctgatgcaccagttatgttggaccgaatgttgcgtctcttagcttgttacaatatcctcacttgttcagttcgtactcaacaagatggaaaggttcagagactttatggtttggctactgttgctaa

SEQ ID NO: 14456 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14457 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14458 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14459 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14460 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatagcctcacttgttcagttcgtactcaacaagatggaaaggttcagagactttatggtttggctactgttgctaa

SEQ ID NO: 14461 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14462 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtcctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14463 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14464 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14465 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagaccttatggtttggctactgttgctaa

SEQ ID NO: 14466 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14467 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctgttcaaattgcttctcagcttccaacaactaaccctgatgcaccagtcatgttgggccgaatgttgcgtctcttggcttgttacaatatcctcacttgttctgttcgtactcaacaagatggaaaggttcagagactttatggtttggctactgttgctaa

SEQ ID NO: 14468 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14469 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 14470 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggttggctactgttgctaa

SEQ ID NO: 14471 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 14472 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14473 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14474 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14475 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 14476 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14477 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14478 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttataatatcctcacttgttcagttcgtactcaacaagatggaaaggttcagagactttatggtttggctactgttgctaa

SEQ ID NO: 14479 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 14480 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaagattcagagactttatggtttggctactgttgctaa

SEQ ID NO: 14481 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggttggctactgttgctaa

SEQ ID NO: 14482 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 14483 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 14484 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14485 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14486 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14487 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgcactcaacaagatggaaaagttcagagactttatggtttggctactgttgctaa

SEQ ID NO: 14488 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaataagatggaaagattcagagactttatggtttggctactgttgctaa

SEQ ID NO: 14489 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggctcagagactttatggtttggctactgttgctaa

SEQ ID NO: 14490 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14491 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctaccaacaactaaccctgatgcaccacttatgttggaccgaatgttgcgtctcttggcttgttacaatatcctcacttgttcagttcgtactcaacaagatggaaagattcagagactttatggtttggctactgttgctaa

SEQ ID NO: 14492 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagcaggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14493 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14494 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14495 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14496 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14497 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14498 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14499 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaggctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14500 - DNA, 466 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaggcgctggagacggtgcaggcgctgttgccggtgctgtgccaggcccacggcttgaccccggagcaggtggtggccatcgccagcaatattggtggcaagcaggcgctggacgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14501 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggatctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14502 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctctaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14503 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14504 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14505 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14506 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14507 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14508 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 14509 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtcacttggcttgttacaatatcctcacttgttcagttcgtactcaacaagatggaaaggttcagagactttatggtttggctactgttgctaa

SEQ ID NO: 14510 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 14511 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14512 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctattggcttgttacaatatcctcacttgttcagttcatactcaacaagatggaaagattcagagactttatggtttggctactgttgctaa

SEQ ID NO: 14513 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaattttgcgtctcttggcttgttacaatatcctcacttgttcagttcgtactcaacaagatggaaagattcagagactttatggtttggctactgttgctaa

SEQ ID NO: 14514 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggtgcagagactttatggtttggctacttgctaa

SEQ ID NO: 14515 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 14516 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaggatggaaagattcagagactttatggtttggctactgttgctaa

SEQ ID NO: 14517 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggttactgttgctaa

SEQ ID NO: 14518 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaacatcctcacttgttcagttcgtactcaacaagatggaaaggttcagagactttatggtttggctactgttgctaa

SEQ ID NO: 14519 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14520 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 14521 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14522 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14523 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14524 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctatgttgctaa

SEQ ID NO: 14525 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14526 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctaccaacaactaaccctgatgcaccagttatgtaggaccgaatgttgcgtctcttggcttgttacaatatcctcacttgttcagttcgtactcaacaagatggaaaggttcagagactttatggtttggctactgttgctaa

SEQ ID NO: 14527 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcatctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14528 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctatggaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14529 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctactgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14530 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14531 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14532 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctaaagctggacctggtgctcaaatttcacctattgaaattgcttctcagctcccagcaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14533 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14534 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtgctaa

SEQ ID NO: 14535 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctaaagctggacctggtgctcaaatttcacctattgaaattgcttctcagctcccaacaactaaccctgatgcaccagttatgttggaccgaatgttgcgtctctcggcttgttacaatatcctcacttgttcagttcgtactcaacaagatggaaaggttcagagactttatggtttggctactgttgctaa

SEQ ID NO: 14536 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14537 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14538 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgggaagattcagagactttatggtttggctactgttgctaa

SEQ ID NO: 14539 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14540 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctaaagctggacctggtgctcaaatttcacctattgaaattgcttctcagctaccaacaactaaccctgatgcaccagttatgttggaccgaatgttgcgtctcttggcttgtttcaatatcctcgcttgttcagttcgtactcaacaagattgaaagattcagagactttatagtttggctactgttgctaa

SEQ ID NO: 14541 - DNA, 395 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagcgccggcctgccgccgccattgctggcgatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14542 - DNA, 395 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagcgccggcctgccgccgccattgctggcgatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14543 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagcgccggcctgccgccgccattgccatctaaagctggacctggtgctcaaatttcacctgttcaaattgcttctcagcttccaacaactaaccctgatgcaccagttatgttggaccgaatgtggcgtctcttggctagttacaatatcctcacttgttcagttcgtactcaacaagatggaaaggttcagagactttatggtttggctactgttgctaa

SEQ ID NO: 14544 - DNA, 424 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagcaggtgttggccatcgccagcaatattggtgccaagcaggcgctggagacggtgcaggcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14545 - DNA, 424 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagcaggtgttggccatcgccagcaatattggtgccaagcaggcgctggagacggtgcaggcgctaaagctggacctggtgctcaaatttcacctattgaaattgcttctcagctaccaacaactaaccctgatgcaccagttaggttggaccgaatgttgcgtctcttggcttgttacaatatcctcacttgttcagttcgtactcaacaagatggaaaggttcagagactttatggtttggctactgttgctaa

SEQ ID NO: 14546 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagcaatggcggcggcaggccggcgctggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14547 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagcaatggcggcggcaggccggcgctggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14548 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggggggtcaagccgtgggcctggcacagcaccggcaacagccgctggaccgtctccagcgcctgcagctggaccttgtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14549 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggggggtcaagccgtgggcctggcacagcaccggcaacagccgctggaccgtctccagcgcctgaagctcgacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14550 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggccctggtgctcaaatttcaactattgaaattgcttctcagctcccaacaactaaccctgatgcaccagttatgtttgaccgaatgttgcgtatcttggcttgttacaatatcctcacttgtgcagttcgtactcaacaagagggaaaggttcagagaatttatggtttggcgactgttgctaa

SEQ ID NO: 14551 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14552 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggacctggtgctcaaatttcacctattgaaatttcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14553 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14554 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14555 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 14556 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14557 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14558 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14559 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14560 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14561 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaagttcagagactttatggtttggctactgttgctaa

SEQ ID NO: 14562 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 14563 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggacctggtgctcaaatgtcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14564 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactggacctggcgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14565 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14566 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14567 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14568 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaagctggacctggtgctcaaatttcacctattgaaattgcttctcagctaccaacaactaaccctgatgcaccagttatgttggaccgaatgttgcgtctcttggcttgttacaatatcctcactttttcagttcgtactcaacaagatggaaagattcagagactttatggtttggctactgttgctaa

SEQ ID NO: 14569 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaaagctggcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14570 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaaagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14571 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 14572 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14573 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14574 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14575 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttctaa

SEQ ID NO: 14576 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14577 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14578 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcatttgttcagttcgtactcaacaagatggaaagattcagagactttatggtttggctactgttgctaa

SEQ ID NO: 14579 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 14580 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14581 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14582 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14583 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaaagctggacctggtgctcaaatttcacctattgaaattgcttctcagctaccaacaactaaccctgatgcaccagtcatgttggaccgaatgttgcgtctcttggcttgttacaatatcctcacttgatctgttcgtactcaacaagatggaaaggttcagagactttatggtttggctactgttgctaa

SEQ ID NO: 14584 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactaaagctggacctggtgctcaaatttcacctattgaaattgctgctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14585 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacggtccagcggctgttgccggtgctgtgccaggcccacggcttgaccccccagcaggtggtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14586 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacggtccagcggctgttgccggtgctgtgccaggcccacggcttgaccccccagcaggtggtaaagctggacctggtgctcaaatttcacctattgaaattgcttctcagctcccaacaactaaccctgatgcaccagttatgtttgaccgaatgttgcctctcttggcttgttacaatatcctcacttgttcagttcgtactcaacaagatggaaagattcagagcctttatggtttggctactgttgctaa

SEQ ID NO: 14587 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacggtccagcggctgttgccggtgccgtgccaggcccacggcttgaccccccagcaggtggtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14588 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacggtccagcgactgttgccggtgctgtgccaggcccacggcttgaccccccagcaggtggtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14589 - DNA, 456 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacggcttgaccccggagcaggtggtggccatcgccagcaatattggtggcaagcaggcgctggagacggtccagcggctgttgccggtgctgtgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14590 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14591 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagaaactttatggtttggctactgttgctaa

SEQ ID NO: 14592 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 14593 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14594 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 14595 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14596 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14597 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14598 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14599 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14600 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14601 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14602 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatgggttggctactgttgctaa

SEQ ID NO: 14603 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagaggctttatggtttggctactgtttgctaa

SEQ ID NO: 14604 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattctgagactttatggtttggctactgttgctaa

SEQ ID NO: 14605 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14606 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14607 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14608 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14609 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctattgaaattgcttctcagcgcccaacaactaaccctgatgcaccagttatgttggaccgaatgttgcgtctcttggcttgtgacaatatcctcacttgttcagttcgtactcaacaagatggaaagattcagagactttatggtttggctactgttgctaa

SEQ ID NO: 14610 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctattgaaactgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14611 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaccaatggaggcggcaggccggcgctggctaaagatggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14612 - DNA, 447 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacaacgttcaaatccgctcccggcggatttgtcctactcaggatagcgttcaccgacaaacaacagataaaacgaaaggctcagtctaaagctggacctggtgctcaaatttcacctattgaaattgcttctcagctaccaacaactaaccctgatgcaccagttatgttggaccgaatgttgcgtctcttggcttgttataatatcctcacttgttcagttcgtactcaacaagatggaaaggttcagagactttatggtttggctactgttgctaa

SEQ ID NO: 14613 - DNA, 447 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacaacgttcaaatccgctcccggcggatttgtcctactcaggagagcgttcaccgacaaacaacagataaaacgaaaggctcagtctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14614 - DNA, 447 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacaacgttcaaatccgctcccggcggatttgtcctactcaggagagcgttcaccgacaaacaacagataaaacgaaaggctcagtctacagctggacctgatgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 14615 - DNA, 447 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacaacgttcaaatccgctcccggcggatttgtcctactcaggagagcgttcaccgacaaacaacagataaaacgaaaggctcagtctaaagctggacctggtgctcaaatttcacctgttcaaattgcttctcagcttccaacaactaaccctgatgcaccagtcatgttggaccgaatgttgcgtctcttggcttgttacaatatcctcacttgttcatttcgtactcaacaagatggaaaagttcagagactttatggtttggctactgttgctaa

SEQ ID NO: 14616 - DNA, 447 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacaacgttcaaatccgctcccggcggatttgtcctactcaggagagcgttcaccgacaaacaacagataaaacgaaaggctcagtctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 14617 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaatcaatatcactgtgtggcttcaggccgccccgtagaaaagatcaaaggatcttcttgagatcctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14618 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaatcaatatcactgtgtggcttcaggccgccccgtagaaaagatcaaaggatcttcttgagatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14619 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaatcaatatcactgtgtggcttcaggccaccccgtagaaaagatcaaaggatcttcttgagatcctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14620 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaatcaatatcactgtgtggcttcaggccaccccgtagaaaagatcaaaggatcttcttgagatcctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14621 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14622 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtggctaa

SEQ ID NO: 14623 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14624 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14625 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14626 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14627 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaataaagctggacctggtgctcaaatttcacctattgaaattgctgctcagctcccaacaactaaccctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 14628 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaggctggacctggtgctcaaatttcacctattgaaattgcttctcagctcccaacaactaaccctgatgcaccagttatgttggaccgaatgttgcgtctcttggcatgttacaatatcctcacttgttcagttcgtactcaacaagatggaaagattcagagactttatggtttggctactgttgctaa

SEQ ID NO: 14629 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaggctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14630 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctgggcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14631 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggatctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14632 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgcttaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14633 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttctcctattgaaattgcttctcagctcccaacaactaaccctgatgcaccagttatgtgggaccgaatgttgcgtctcttggcttgttacaatatcctcccttcttcagttcgtactcaacaagatagaaaggttcagagactttatggtttggctactgttgctaa

SEQ ID NO: 14634 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttctaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14635 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14636 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14637 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14638 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14639 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14640 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14641 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctacgttgctaa

SEQ ID NO: 14642 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagcttccaacaactaaccctgaagcaccagtcatgttggaccgaatgttgcgtctcttggcttgttacaatatcctcacttgttctgttcgtactcaacaagatggaaaggttcagagactttatggtttggctactgttgctaa

SEQ ID NO: 14643 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14644 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14645 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14646 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14647 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 14648 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgagattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14649 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14650 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14651 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgttgcaccagttatgttggaccgaatgttgcgtctcttggcttgttacaatatcctcacttgttcagttcgtactcaacaagatggaaagattcagagactttatggtttggctactgttgctaa

SEQ ID NO: 14652 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14653 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14654 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14655 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 14656 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14657 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagtttgtactcaacaagatggaaaggttcagagactttatggtttggctactgttgctaa

SEQ ID NO: 14658 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcccttatggtttggctactgttgctaa

SEQ ID NO: 14659 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 14660 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaagattcagagactttatggtttggctactgttgctaa

SEQ ID NO: 14661 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagtctttatggtttggctactgttgctaa

SEQ ID NO: 14662 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcgaa

SEQ ID NO: 14663 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtagctaa

SEQ ID NO: 14664 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 14665 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagacttgatggtttggctactgttgctaa

SEQ ID NO: 14666 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagggactttatggtttggctactgttgctaa

SEQ ID NO: 14667 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagtcattttggaccgaatgttgcgtctcttggcttgttacaatatcctcacttgttctgttcgtactcaacaagatggaaaggttcagagactttatggtttggctactgttgctaa

SEQ ID NO: 14668 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14669 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgacgcaccagttatgttggaccgaatgttgcgtctcttggcttgttacaatatcctcacttgttcagttcgtactcaacaagatggaaagattcagagactttatggtttggctactgttgctaa

SEQ ID NO: 14670 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14671 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14672 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14673 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14674 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggctggttacaatatcctcacttgttcagttcgtactcaacaagatggaaaggttcagagactgtatggtttggctactgttgctaa

SEQ ID NO: 14675 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcggagactttatggtttggctactgttgctaa

SEQ ID NO: 14676 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgctcagttcgtactcaacaagatggaaagattcagagactttatggtttggctactgttgctaa

SEQ ID NO: 14677 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgtgcagttcgtactcaacaagatggaaaggttcagagactttatggtttggctactgttgctaa

SEQ ID NO: 14678 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 14679 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 14680 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgaaaaggttcagagactttatggtttggctactgttgctaa

SEQ ID NO: 14681 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 14682 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14683 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14684 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14685 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtactcaaatttcacctgttcaaattgcttctcagcttccgacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14686 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtactcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14687 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtactcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttattgtttggctactgttgctaa

SEQ ID NO: 14688 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtactcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14689 - DNA, 391 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagcgccggcctgccgccgccattgctggctaaagctggacctggtgctcaaatttcacctgttcaaattgcttctcagcttccaacaactaaccctgatgcaccagtcatgttggaccgaatgttgcgtcttttggcttgttacaatatcctcacttgttcagttcgtactcaacaagatggaaaggttcagagactttatggtttggctactgttgctaa

SEQ ID NO: 14690 - DNA, 391 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagcgccggcctgccgccgccattgctggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14691 - DNA, 391 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagcgccggcctgccgccgccattgctggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14692 - DNA, 391 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagcgccggcctaccgccgccattgctggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14693 - DNA, 391 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagcgccggcatgccgccgccattgctggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14694 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagccgtgggcctggcacagcaccggcaacagccgctggaccgtctccagcgcctgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14695 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaacgctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14696 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaacgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14697 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaacgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14698 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaacgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 14699 - DNA, 385 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaacagataaaacgaaaggctcagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14700 - DNA, 385 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaacagataaaacgaaaggctcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14701 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14702 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14703 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14704 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14705 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14706 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 14707 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgct

SEQ ID NO: 14708 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14709 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14710 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14711 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgacattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14712 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaagttgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14713 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14714 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcctaacaactaaccctgatgcaccagttatgttggaccgaatgtcgcgtctcttggcttgttacaatatcctcacttgttcagttcgtactcaacaagatggaaagattcagagcctttatggtttggctactgttgctaa

SEQ ID NO: 14715 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaacttaccctgatgcaccagttatgttggaccgaatgttgcggctcttggcttgttacaatatcctcgcttgttcagttcgtactcaacaagatggaaaagttcagagactttatggtttggctactgttgctaa

SEQ ID NO: 14716 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcactagttatgttggaccgaatgttgcgtctcttggcttgttacaatatcctcacttgttcagttcgtactcaacaagatggaaagattcagagactttatggtttggctactgttgctaa

SEQ ID NO: 14717 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgtttgtcctaatgtttcgtctcttggcttgttacaatatcctcactttttcagttcgtactcaacaagatggaaagattcagagactttatggtttcgctactgttgctaa

SEQ ID NO: 14718 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14719 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14720 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcactggttcagttcgtactcaacaagatggaaagattcagagactttatggtttggctactgttgcgaa

SEQ ID NO: 14721 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14722 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14723 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactatatggtttggctactgttgctaa

SEQ ID NO: 14724 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 14725 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgtttagttcgtactcaacaagatggaaaggttcagagactttatggtttggctactgttgctaa

SEQ ID NO: 14726 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtctaa

SEQ ID NO: 14727 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttgctactgttgctaa

SEQ ID NO: 14728 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcaa

SEQ ID NO: 14729 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgatcagttcgtactcaacaagatggaaagattcagagactttatggtttggctactgttgctaa

SEQ ID NO: 14730 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 14731 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagacgttatggtttggctactgttgctaa

SEQ ID NO: 14732 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcggcgcttggcttgttacaatatcctcgcgtgttcagttcgtactgaacaggatggaaaagttcagagactgtatggtttggctactggggcgag

SEQ ID NO: 14733 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgaaaaagttcagagactttatggtttggctactgttgctaa

SEQ ID NO: 14734 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtcctcaacaagatggaaagattcagagactttatggtttggctactgttgctaa

SEQ ID NO: 14735 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggatcgaatgttgcgtctcttggcttgttacaatatcctcacttgttcagttcgtactcaacaagatggaaagattcagagactttatggtttggctactgttgctaa

SEQ ID NO: 14736 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 14737 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggttactgttgctaa

SEQ ID NO: 14738 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 14739 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtcctcaacaagatggaaagattcagagactttatggtttggctctgttgcta

SEQ ID NO: 14740 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctacctgttgctaa

SEQ ID NO: 14741 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggataggttcagagactttatggtttggctactgttgctaa

SEQ ID NO: 14742 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 14743 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttagaccgaatgttgcgtctcttggcttgttacaatatcctcacttgttcagttcgtactcaacaagatggaaaggttcagagactttatggtttggctactgttgctaa

SEQ ID NO: 14744 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14745 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctaatgcaccagttatgttggaccgaatgttgcgtctcttggcttgttacaatatcctcacttgttcagttcgtactcaacaagatggaaagattcagagactttatggtttggctactgttgctaa

SEQ ID NO: 14746 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacagctaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14747 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14748 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14749 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14750 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14751 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtcccttggcttgttacaatatcctcacttgttcagttcgtactcaacaagatggaaaggttcagagactttatggtttggctactgttgctaa

SEQ ID NO: 14752 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtcctcaacaagatggaaaggttcagagactttatggtttggctactgttgctaa

SEQ ID NO: 14753 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 14754 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgctcagttcgtactcaacaagatggaaaggttcagagactttatggtttggctactgttgctaa

SEQ ID NO: 14755 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtaa

SEQ ID NO: 14756 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 14757 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 14758 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgtaggaccgaatgttgcgtctcttggcttgttacaatatcctcacttgttcagttcgtactcaacaagatggaaaggttcagagactttatggtttggctactgttgctaa

SEQ ID NO: 14759 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttcacagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14760 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14761 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatctcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14762 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatatcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14763 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctaaaatttcacctattgaaattgcttctcagctcccaacacctacccctgatgcaccagttatgttggaccgaatgttgcgtctcttggcttgttacaatatcctcacttgttcagttcgaactcaacaagatggaaagattcagagcctttatggtttggctactgttgctaa

SEQ ID NO: 14764 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgcccaaatttcacctattgaaattgcttctcagctcccaacaactaaccctgatgcaccagttatgttggaccgaatgttgcgtctcttgacttgttacaatatcctcacttgttcagttcgtactcaacaagatggaaaggttcagagactttatggtttagctactggtgctaa

SEQ ID NO: 14765 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctgatgctcaaatttcacctattgaaattgcttctcagctcccaacaactaaccctgatgcaccagttatgttagtccgaatgttgcgtctcttggcttgttacaatatcctcacttgttcagttcgtactcaacaagatggaaaggttcagagactttatggtttggctactgatacaaa

SEQ ID NO: 14766 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctagacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14767 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaacgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 14768 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14769 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14770 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14771 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacgagatggaaaggttcagagactttatggtttggctactgttgctaa

SEQ ID NO: 14772 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14773 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14774 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttagggtttggctactgttgctaa

SEQ ID NO: 14775 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaacggttcagagactttatggtttggctactgttgctaa

SEQ ID NO: 14776 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14777 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14778 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14779 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatgatttggctactgttgctaa

SEQ ID NO: 14780 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14781 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14782 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14783 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatgttttggctactgttgctaa

SEQ ID NO: 14784 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14785 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14786 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaagattcagagactttatggtttggctactgttgctaa

SEQ ID NO: 14787 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatccgcacttgttcagttcgtactcaacaagatggaaaggttcagagactttatggtttggctactgttgctaa

SEQ ID NO: 14788 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14789 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 14790 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctaccaccaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14791 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctaccaacgactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14792 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14793 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14794 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14795 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctagttgctaa

SEQ ID NO: 14796 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttacggtttggctactgttgctaa

SEQ ID NO: 14797 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14798 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14799 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatattaaagctggacctggtgctcaaatttcacctattgaaattgcttctcagctcccaacaactaaccctgatgcaccagttattttttaccgaatgtttcgtctcttggcttgttacaatatcctcacttgttcagttcgtactcaacaagatggaaagattcagagactttatggtttggctactgttgctaa

SEQ ID NO: 14800 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14801 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatattaaagctggacctggtgctcaaatttcacctattgaaattgcttctcagctcccaacaactaaccctgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 14802 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatattaaagctggacctggtgctcaaatttcacctattgaaattgcttctcagctcccaacaactaaccctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 14803 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14804 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14805 - DNA, 469 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatatattgctggcgatggccaccacctgctccggggtcaagccgtgggcctggcacagcaccggcaacagccgctggaccgtctccagcgcctgcttgccaccattattgctacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14806 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14807 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14808 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataagctggacctggtgctcaaatttcacctattgaaattgcttctcagctcccaacaactaaccctgatgcaccagttatgttggaccgaatgttgcgtctcttggcttgttacaatatcctcacttattcagttcgtactcaacaagatggaaaggttcagagactttatggtttggctactgttgctaa

SEQ ID NO: 14809 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14810 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14811 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14812 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14813 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14814 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 14815 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14816 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagatgcagagactttatggtttggctactgtctaa

SEQ ID NO: 14817 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagctcccaacaagtaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14818 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagctcccaacaactaaccctgatgcatcagttatgttggaccgaatgttgcgtctcttggcttgttacaatatcctcacttgttcagttcgtactcaacaagattgaaaggttcagagcctttatggtttggctactgttgctaa

SEQ ID NO: 14819 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14820 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14821 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14822 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagctcccaacaactaaccctgatgcaccagttatgttggaccgaatgatgcgtctcttggcttgttacaatatcctcacttgttcagttcgtactcaacaagatggaaagattcagagactttatggtttggctactgttgctaa

SEQ ID NO: 14823 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggttactgttgctaa

SEQ ID NO: 14824 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 14825 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaagattcagagactttatggtttggctactgtagctaa

SEQ ID NO: 14826 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14827 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14828 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagctaccaacaactaaccctgatgcaccagttatgttggactgaatgttgcgtctcttggcttgttacaatatcctcacttgttcagttcgtactcaacaagatggaaaggttcagagactttatggtttggctactgttgctaa

SEQ ID NO: 14829 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagctaccaacaactaaccctgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 14830 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14831 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 14832 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14833 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctctgctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14834 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctccgctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14835 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14836 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctcccaacgactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14837 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14838 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14839 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14840 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14841 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtattcaacaagatggaaaggttcagagactttatggtttggctactgttgctaa

SEQ ID NO: 14842 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 14843 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctgttgctaa

SEQ ID NO: 14844 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 14845 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatggtgcgtctcttggcttgttacaatatcctcacttgttcagttcgtactcaacaagatggaaaagttcagagactttatggtttggctactgttgctaa

SEQ ID NO: 14846 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagattttatggtttggctactgttgctaa

SEQ ID NO: 14847 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctcccaacaactaaccctgatgcaccagttaagttggaccgaatgttgcgtctcttggcttgttacaatatcctcacttgttcagttcgtactcaacaagatggaaagattcagagactttatggtttggctactgttgctaa

SEQ ID NO: 14848 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14849 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14850 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14851 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtaatcaacaagatggaaaggttcagagactttatggtttggctactgttgctaa

SEQ ID NO: 14852 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14853 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaattacacctattgaaattgttgctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14854 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14855 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 14856 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14857 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14858 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14859 - DNA, 334 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggttgctaa

SEQ ID NO: 14860 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14861 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14862 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatacaatatcctcacttgttcagttcgtactcaacaagatggaaagattcagagactttatggtttggctactgttgctaa

SEQ ID NO: 14863 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatacaatatcctcacttgttcagttcgtactcaacaagatggaaaagttcagagactttatggtttggctactgttgctaa

SEQ ID NO: 14864 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataatctgtacctggtgctcaaatttcacctgttcaaattgcttctcagcttccaacaactaaccctgatgcaccacttatgttggaccgaattttgcgtctcttggcttgttacaatatcctcacttgttcagttcgtactcaacaagatggaaaggttcagagcctttatggtttggctactgttgctaa

SEQ ID NO: 14865 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14866 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaggctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14867 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaattttacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14868 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14869 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14870 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14871 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14872 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaaccagatggaaaggttcagagactttatggtttggctactgttgctaa

SEQ ID NO: 14873 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14874 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14875 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14876 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgagattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14877 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcatctcccaacaactaaccctgatgcaccagttatgttggaccgaatgttgcgtcacttggcttgttacaatatcctcacttgttcagttcgtactcaacaagatggaaaggttcagagacttcatggtttggctactgttgctaa

SEQ ID NO: 14878 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14879 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 14880 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctgccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14881 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14882 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaattttgcgtctcttggctggttacaatatcctcacttgttcagttcgtactcaacaagatggaaaggttcagagactttatggtttggctactgttgctaa

SEQ ID NO: 14883 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 14884 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14885 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctat

SEQ ID NO: 14886 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactttgctaa

SEQ ID NO: 14887 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtttcttggcttgttacaatatcctcacttgttcagttcgtactcaacaagatggaaaggttcagagactttatggtttggctactgttgctaa

SEQ ID NO: 14888 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtttaa

SEQ ID NO: 14889 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 14890 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacagtatcctcacttgttcagttcgtactcaacaagatggaaaggttcagagactttatggtttggctactgttgctaa

SEQ ID NO: 14891 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14892 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14893 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggtgcagagactttatggtttggctactgtctaa

SEQ ID NO: 14894 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaacatcctcacttgttcagttcgtactcaacaagatggaaagattcagagactttatggtttggctactgttgctaa

SEQ ID NO: 14895 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcatttcgtactcaacaagatggaaagattcagagactttatggtttggctactgttgctaa

SEQ ID NO: 14896 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgtgcagttcgtactcaacaagatggaaagattcagagactttatggtttggctactgttgctaa

SEQ ID NO: 14897 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctctttgcttgttacaatatcctcacttgttcagttcgtactcaacaagatggaaaggttcagagactttatggtttggctactgttgctaa

SEQ ID NO: 14898 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttgacttgttacaatatcctcacttgttcagttcgtactcaacaagatggaaagattcagagactttatggtttggctactgttgctaa

SEQ ID NO: 14899 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttaaggtttggctactgttgctaa

SEQ ID NO: 14900 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatgggttggctactgtttgctaa

SEQ ID NO: 14901 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 14902 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 14903 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaagattcagagactttatggtttggctactgttgctaa

SEQ ID NO: 14904 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatccccacttgttcagttcgtactcaacaagatggaaaggttcagagactttatggtttggctactgttgctaa

SEQ ID NO: 14905 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttgtggtttggctactgttgctaa

SEQ ID NO: 14906 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 14907 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctatcaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14908 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctaccaacatctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14909 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14910 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14911 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14912 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgtttaa

SEQ ID NO: 14913 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 14914 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcatttcgtactcaacaagatggaaaggttcagagactttatggtttggctactgttgctaa

SEQ ID NO: 14915 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggtactgttgctaa

SEQ ID NO: 14916 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagcccccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14917 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagataccaacaactaaccctgatgcaccagttatgttggaccgaatgttgcgtctcttggcttgttacaatatcctcacttgttcagttcgtactcaacaagatggaaatgttcagagactttatggtttggttactgttgctaa

SEQ ID NO: 14918 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14919 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataacgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14920 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14921 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacttggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14922 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggttctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 14923 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacttattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14924 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgtaccagtcatgttggaccgaatgttgcgtctcttggcttgttacaatatcctcacttgttctgttcgtactcaacaagatggaaaggttcagagactttatggtttggctactgttgctaa

SEQ ID NO: 14925 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgctccagtcatgttggaccgaatgttgcgtctcttggcttgttacaatatcctcacttgttctgttcgtactcaacaagatggaaaggttcagagactttatggtttggctactgtttaa

SEQ ID NO: 14926 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14927 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14928 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14929 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 14930 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatgggaaggttcagagaatttatggtttggctatgctaa

SEQ ID NO: 14931 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttgtaccgaatgttgcgtctcttggcttgttacaatatcctcacttgtcctgttcgtactcaacaagatggaaaggttcagagactttatggtttggctactgttgctaa

SEQ ID NO: 14932 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14933 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14934 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactggctaa

SEQ ID NO: 14935 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 14936 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtcgcttggcttgttacaatatcctcacttgttctgttcgtactcaacaagatggaaaggttcagagactttatggtttggctactgttgctaa

SEQ ID NO: 14937 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagcttcagagactttatggtttggctactgttgctaa

SEQ ID NO: 14938 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgtggctaa

SEQ ID NO: 14939 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 14940 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggatactgttgctaa

SEQ ID NO: 14941 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtacccaacaagatggaaaggttcagagactttatggtttggctactgttgctaa

SEQ ID NO: 14942 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtaatcaacaagatggaaagattcagagactttatggtttggctatgttgctaa

SEQ ID NO: 14943 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatgggtttggctactgttgctaa

SEQ ID NO: 14944 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctatgttgctaa

SEQ ID NO: 14945 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagcctttatggtttggctactgttgctaa

SEQ ID NO: 14946 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaagatcctcacttgttctgttcgtactcaacaagatggaaaggttcagagactttatggtttggctactgttgctaa

SEQ ID NO: 14947 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14948 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14949 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14950 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14951 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14952 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14953 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttaaggtttggctactgttgctaa

SEQ ID NO: 14954 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctggtcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14955 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctcttgacattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14956 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgatattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14957 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgacattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14958 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14959 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14960 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14961 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14962 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14963 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14964 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 14965 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 14966 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 14967 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctgccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14968 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctgccaacaactaaccctgatgcaccagttatgttggaccgaatgttgcgtctcttggcttgttacaatatcctaacttgttcagttcgtactcaacaagatggaaaggttcagagactttatggtttggctactgttgctaa

SEQ ID NO: 14969 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaattaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14970 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactagccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14971 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgattcaccagttatgttggaccgaatgttgcgtctcttggcttgttacaatatcctcacttgttcagttcgtactcaacaagatggaaagattcagagactttatggtttggctactgttgctaa

SEQ ID NO: 14972 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcactagttatgttggaccgaatgttgcgtctcttggcttgttacaatatcctcacttgttcagttcgtactcaacaagatggaaagattcagagactttatggtttggctactgttgctaa

SEQ ID NO: 14973 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 14974 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 14975 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 14976 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 14977 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttctaa

SEQ ID NO: 14978 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgataa

SEQ ID NO: 14979 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctaatgttgctaa

SEQ ID NO: 14980 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttctgttcgtacccaacaagatggaaaggttcagagactttatggtttggctactgttgctaa

SEQ ID NO: 14981 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 14982 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcagcaagatggaaaggttcagagactttatggtttggctactgttgctaa

SEQ ID NO: 14983 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 14984 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagtacgtactcaacaagatggaaagattcagagactttatggtttggctactgttgctaa

SEQ ID NO: 14985 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 14986 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcttactgttgctaa

SEQ ID NO: 14987 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 14988 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcctggcttgttacaatatcctcacttgttcagttcgtactcaacaagatggaaagattcagagactttatggtttggctactgttgctaa

SEQ ID NO: 14989 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 14990 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgtaa

SEQ ID NO: 14991 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggcttggctactgttgctaa

SEQ ID NO: 14992 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 14993 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacgatatcctcacttgttcagttcgtactcaacaagatggaaagattcagagactttatggtttggctactgttgctaa

SEQ ID NO: 14994 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcatagactttatggtttggctactgttgctaa

SEQ ID NO: 14995 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcactcgttcagttcgtactcaacaagatggaaaggttcagagactttatggtttggctactgttgctaa

SEQ ID NO: 14996 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtttctaa

SEQ ID NO: 14997 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcggactcaaccagatggaaagattcagagactttatggtttggctactgttgctaa

SEQ ID NO: 14998 - DNA, 368 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctacttttgctactgttgctaa

SEQ ID NO: 14999 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 15000 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcatttgttcagttcgtactcaacaagatggaaaggttcaaagactttatggtttggctactgttgata

SEQ ID NO: 15001 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaagatcctcacttgttcagttcgtactcaacaagatggaaagattcagagactttatggtttggctactgttgctaa

SEQ ID NO: 15002 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaagaagatggaaaagttcagagactttatggtttggctactgttgctaa

SEQ ID NO: 15003 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcatttcgtactcaacaagatggaaagattcagagactttatggtttggctactgttgctaa

SEQ ID NO: 15004 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 15005 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctaccgttgctaa

SEQ ID NO: 15006 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 15007 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctaccgttgctaa

SEQ ID NO: 15008 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 15009 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttaaggtttggctactgttgctaa

SEQ ID NO: 15010 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 15011 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgatacaatatcctcacttgttcagttcgtactcaacaagatggaaaggttcagagactttatggtttggctactgttgctaa

SEQ ID NO: 15012 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 15013 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaagattcagagactttatggtttggctactgttgctaa

SEQ ID NO: 15014 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagtttgtactcaacaaaatggaaagattcagagactttatggtttggctactgttgctaa

SEQ ID NO: 15015 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatccacacttgttcagttcgtactcaacaagatggaaagattcagagactttatggtttggctactgttgctaa

SEQ ID NO: 15016 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttgcaatatcctcacttgttcagttcgtactcaacaagatggaaagattcagagactttatggtttggctactgttgctaa

SEQ ID NO: 15017 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 15018 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 15019 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 15020 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttacggtttggctactgttgctaa

SEQ ID NO: 15021 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttacgtctcttggcttgttacaatatcctcacttgttcagttcgtactcaacaagatggaaagattcagagactttatggtttggctactgttgctaa

SEQ ID NO: 15022 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggttactgttgctaa

SEQ ID NO: 15023 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggttggctactgttgctaa

SEQ ID NO: 15024 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 15025 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtctaa

SEQ ID NO: 15026 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 15027 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 15028 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttacgtctcttggcttgttacaatatcctcacttgttcagttcgtactcaacaagatggaaaggttcagagactttatggtttggctactgttgctaa

SEQ ID NO: 15029 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgcactcaacaagatggaaaggttcagagactttatggtttggctactgttgctaa

SEQ ID NO: 15030 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtcctcaacaagatggaaagattcagagactttatggtttggcgactgttgctaa

SEQ ID NO: 15031 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttcttcagttcgtactcaacaagatggaaaggttcagagactttatggtttggctactgttgctaa

SEQ ID NO: 15032 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 15033 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttattgtttggctactgttgctaa

SEQ ID NO: 15034 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 15035 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctacttttgctaa

SEQ ID NO: 15036 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15037 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15038 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactgaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15039 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 15040 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15041 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttgcaatatcctcacttgttcagttcgtactcaacaagatggaaagattcagagactttatggtttggctactgttgctaa

SEQ ID NO: 15042 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15043 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgcctcttggcttgttacaatatcctcacttgttcagttcgtactcaacaagatggaaaggttcagagactttatggtttggctactgttgctaa

SEQ ID NO: 15044 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15045 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcgtggcttgttacaatatcctcacttgttcagttcgtactcaacaagatggaaaggttcagagactttatggtttggctactgttgctaa

SEQ ID NO: 15046 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcgtggcttggtacaatttcctcacttgttcagttcgttcccaaccagatggaaagattcagagactttatggtttggctactgttgctaa

SEQ ID NO: 15047 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 15048 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctctgggcttgttacaatatcctcacttgttcagttcgtactcaacaagatggaaaggttcagagactttatggtttggctactgttgctaa

SEQ ID NO: 15049 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15050 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 15051 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggacagaatgttgcgtctcttggcttgttacaatatcctcacttgttcagttcgtactcaacaagatggaaagattcagagactttatggtttggctactgttgctaa

SEQ ID NO: 15052 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttgacttgttacaatatcctcacttgttcagttcgtactcaacaagatggaaaagttcagagactttatggtttggctactgttgctaa

SEQ ID NO: 15053 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggctggttacaatatcctcacttgttcagttcgtactcaacaagatggaaagattcagagactttatggtttggctactgttgctaa

SEQ ID NO: 15054 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 15055 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 15056 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcctgttacaatatcctcacttgttcagttcgtactcaacaagatggaaaggttcagagactttatggtttggctactgttgctaa

SEQ ID NO: 15057 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 15058 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactttgctaa

SEQ ID NO: 15059 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagtccgtactcaacaagatggaaaagttcagagactttatggtttggctactgttgctaa

SEQ ID NO: 15060 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttaaatatcctcacttgttcagttcgtactcaacaagatggaaaggttcagagactttatggtttggctactgttgctaa

SEQ ID NO: 15061 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 15062 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtcacttggcttgttacaatatcctcacttgttcagttcgtactcaacaagatggaaaggttcagagactttatggtttggctactgttgctaa

SEQ ID NO: 15063 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagtctttatggtttggctactgttgctaa

SEQ ID NO: 15064 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtcacttggcttgttacaatatcctcacttgttcagttcgtactcaacaagatggaaagattcagagactttatggtttggctactgttactaa

SEQ ID NO: 15065 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagacttgatggtttggctactgttgctaa

SEQ ID NO: 15066 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacctgttcagttcgtactcaacaagatggaaagattcagagactttatggtttggctactgttgctaa

SEQ ID NO: 15067 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 15068 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcactggttcagttcgtactcaacaagatggaaaggttcagagactttatggtttggctactgttgctaa

SEQ ID NO: 15069 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgtaa

SEQ ID NO: 15070 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttgctactgttgctaa

SEQ ID NO: 15071 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 15072 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgtgcagttcgtactcaacaagatggaaaggttcagagactttatggtttggctactgttgctaa

SEQ ID NO: 15073 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgtgggaccgaatgttgcgtctcttggcttgttacaatatcctcacttgttcagttcgtactcaacaagatggaaaggttcagagactttatcgtttggatactgttgctaa

SEQ ID NO: 15074 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgctggaccgaatgttgcgtctcttggcttgttacaatatcctcacttgttcagttcgtactcaacaagatggaaaggttcagagactttatggtttggctactgttgctaa

SEQ ID NO: 15075 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15076 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15077 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15078 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcacctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15079 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttcccagctcccaacaactaaccctgatgcaccagttatgttggaccgaatgttgcgtctcttggcttgttacaatatcctcacttgttcagttcgtactcaacaagatggaaaagttcagagactttatggtttggcgactgttgctaa

SEQ ID NO: 15080 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaatcgcttctcagctcccaacaactaaccctgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 15081 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15082 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattaaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15083 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15084 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctaaaatttcacctgtccaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15085 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgcgcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15086 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15087 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgcacaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15088 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgatcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15089 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtactcaaatttcacctgttcaaattgcttctcagcttccaacaactaaccctgatgcaccagtcatgttggaccgaatgttgcgtctcttggcttgttacaatatcctcacttgttcagttcgtcctcaacaagatggaaagattcagagactttatggtttggctactgttgctaa

SEQ ID NO: 15090 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtactcaaatttcacctgttcaaattgcttctcagcttccaacaactaaccctgatgcaccagtcatgttggaccgaatgttgcgtctcttggcttgttacaatatcctcccttgttctgttcgtactcaacaagatggaaaggttcagagactttatggtttggctactgttgctaa

SEQ ID NO: 15091 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggaccaggtgctcaaatttcacctattgaaattgcttctcagctcccaacaactaaccctgatgcaccagttatgttggaccgaatgttgcgcctcttggcttgttacaatatcctcacttgttcagttcgtactcaacaagatggaaaagttcagagactttatggtttggctactgttgctaa

SEQ ID NO: 15092 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggaactggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15093 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15094 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15095 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaaagctggacctggtgctcaaatttcacctattgaaattgcttctcaactaccaacaactaaccctgatgcaccagttatgttggaccgaatgttgcgtctcttggcttgttacaatatcctcacttgttcagtccgtactcaacaagatggaaaagttcagagactttatggtttggctactgttgctaa

SEQ ID NO: 15096 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagtaaagctggacctggtgctcaaatttcacctattgaaattgcttctcagtgcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15097 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15098 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15099 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15100 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagtaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15101 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15102 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgttcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15103 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15104 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15105 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15106 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15107 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15108 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15109 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15110 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15111 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15112 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15113 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctacttgctaa

SEQ ID NO: 15114 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 15115 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 15116 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcctggcttgttacaatatcctcacttgttcagttcgtactcaacaagatggaaagattcaaagactttatggtttggctactgttgctaa

SEQ ID NO: 15117 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttcggttcgtactcaacaagatggaaaggttcagagactttatggtttggctactgttgctaa

SEQ ID NO: 15118 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagcctttatggtttggctactgttgctaa

SEQ ID NO: 15119 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15120 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15121 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15122 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgcaa

SEQ ID NO: 15123 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15124 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15125 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcaacttccaacaactaaccctgatgcaccagtcatgttggaccgaatgttgtgtctcttggcttgttacaatatcctcacttgttctgttcgtactcaacaagatggaaaggttcagagactttatggtttggctactgtgctaa

SEQ ID NO: 15126 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgtacaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggcactgttgctaa

SEQ ID NO: 15127 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttcttagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15128 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15129 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgcaa

SEQ ID NO: 15130 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15131 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15132 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgttgcaccagttatgttggaccgaatgttgcgtctcttggcttgttacaatatcctcactttttcagttcgtactcaacaagatggaaagattcagagactttatggtttggctactgttgctaa

SEQ ID NO: 15133 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgtaccagttatgttggaccgaatgttgcgtctcttggcttgttacaatatcctcacttgttcagttcgtactcaacaagatggaaagattcagagactttatggtttggctactgttgctaa

SEQ ID NO: 15134 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 15135 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccggttatgttggaccgaatgttgcgtctcttggcttgttacaatatcctcacttgttcagttcgtactcaacaagatggaaaagttcagagactttatggtttggctactgttgctaa

SEQ ID NO: 15136 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 15137 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggacctaatgttgcgtcgcttggcttgttacaatatcctcacttgttcagttcgtactcaacaagatggaaaggttcagagtctttatggtttggctactgttgctaa

SEQ ID NO: 15138 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgagtgttgcgtctcttggcttgttacaatatcctcacttgttcagttcgtactcaacaagatggaaaggttcagagactttatggtttggctactgttgctaa

SEQ ID NO: 15139 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15140 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15141 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttgcaatatcctcacttgttcagttcgtactcaacaagatggaaagattcagagactttatggtttggctactgttgctaa

SEQ ID NO: 15142 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggattgttacaatatcctcacttgttcagttcgtactcaacaagatggaaaggttcagagactttatggtttggctactgttgctaa

SEQ ID NO: 15143 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15144 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 15145 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 15146 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagatgcagagactttatggtttggctactggctaa

SEQ ID NO: 15147 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 15148 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttctgagactttatggtttggctactgttgctaa

SEQ ID NO: 15149 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgcactcaacaagatggaaaagttcagagactttatggtttggctactgttgctaa

SEQ ID NO: 15150 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggtactgttgctaa

SEQ ID NO: 15151 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggtaagattcagagactttatggtttggctactgttgctaa

SEQ ID NO: 15152 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 15153 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgactgtgctaa

SEQ ID NO: 15154 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttgtcttgttacaatatcctcacttgttcagttcgtactcaacaagatggaaaggttcagagactttatggtttggctactgttgctaa

SEQ ID NO: 15155 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctctcttgttcagttcgtactcaacaagatggaaagattcagagactttatggtttggctactgttgctaa

SEQ ID NO: 15156 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaataagatggaaaagttcagagactttatggtttggctactgttgctaa

SEQ ID NO: 15157 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatagaaagattcagagactttatggtttggctactgttgctaa

SEQ ID NO: 15158 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaagggttcagagactttatggtttggctactgttgctaa

SEQ ID NO: 15159 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 15160 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgctgcgtctcttggcttgttacaatatcctcacttgttcagttcgtactcaacaagatggaaagattcagagactttatggtttggctactgttgctaa

SEQ ID NO: 15161 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcgcttgttcagttcgtactgaacaagatggaaaggttcagagactttatggtttggctactgttgctaa

SEQ ID NO: 15162 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggttactgttgctaa

SEQ ID NO: 15163 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 15164 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgtaaagattcagagactttatagtttggctactgttgctaa

SEQ ID NO: 15165 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15166 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtcctcagcaagatataaagattcagagaattgatggtttggctacttttgctaa

SEQ ID NO: 15167 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 15168 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctctttgcttgttacaatatcctcacttgttcagttcgtactcaacaagatggaaaggttcagagactttatggtttggctactgttgctaa

SEQ ID NO: 15169 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctacttgctaa

SEQ ID NO: 15170 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgtgcagttcgtactcaacaagatggaaaggttcagagactttatggtttggctactgttgcta

SEQ ID NO: 15171 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagaccttatggtttggctactgttgctaa

SEQ ID NO: 15172 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagggactttatggtttggctactgttgctaa

SEQ ID NO: 15173 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggctcagagactgtatggtttggctactgttgctaa

SEQ ID NO: 15174 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcctgttacaatatcctcacttgttcagttcgtactcaacaagatggaaaggttcagagactttatggtttggctactgttgctaa

SEQ ID NO: 15175 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattaagagactttatggtttggctactgttgctaa

SEQ ID NO: 15176 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctga

SEQ ID NO: 15177 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgtttctaa

SEQ ID NO: 15178 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaaa

SEQ ID NO: 15179 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcaactgttgctaa

SEQ ID NO: 15180 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggcttggctactgttgctaa

SEQ ID NO: 15181 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 15182 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttaggttggaccgaatgtggcgtctcttggctggttacagtatcctcacttgttcagttcgtactcaacaagatggaaagattcagagactttatggtttggctactgttgctaa

SEQ ID NO: 15183 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttacgttggaccgattgttgcgtctcttggcttgttacaatatcctcacttgttcagttcgtactcaacaagatggaaaggttcagagactttatggtttggctactgttgctaa

SEQ ID NO: 15184 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15185 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 15186 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15187 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactgaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15188 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaacccttatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15189 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 15190 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15191 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15192 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15193 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 15194 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacctgttcagttcgtactcaacaagatggaaagattcagagactttatggtttggctactgttgctaa

SEQ ID NO: 15195 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 15196 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtcgctaa

SEQ ID NO: 15197 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15198 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 15199 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttattgtttggctactgttgctaa

SEQ ID NO: 15200 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 15201 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 15202 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaagttcagagcctttatggtttggctactgttgctaa

SEQ ID NO: 15203 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttagggtttggctactgttgctaa

SEQ ID NO: 15204 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaagatcatcacttgttcagttcgtactcaacaagatggaaaggttcagagactttatggtttggctact

SEQ ID NO: 15205 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcatcacttgttcagttcgtactcaacaagatggaaaggttcagagactttatggtttggctactgttgctaa

SEQ ID NO: 15206 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggctggttacaatatcctcacttgttcagttcgtactcaacaagagggaaaggttcagagactttatggtttggctactgttgctaa

SEQ ID NO: 15207 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15208 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15209 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagcccccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15210 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaatcgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 15211 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattaaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15212 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctatagaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15213 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgatcaaatttcacctattgaaattgcttctcagctaccaacaactaaccctgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 15214 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15215 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15216 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15217 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15218 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctgctgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15219 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggaccaggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15220 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15221 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15222 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15223 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15224 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15225 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15226 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15227 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15228 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15229 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15230 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctattgaaattgcttctcagctcccaacaactaaccctgatgcaccagttatgttggaccgaatgttacgtctcttggcttgttacaatatcctcacttgttcagttcgtactcaacaagatggaaagattcagagactttatggtttggctactgttgctaa

SEQ ID NO: 15231 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctattgaaattgcttctcagctcccaacaactaaccctgacgcaccagttatgttggaccgaatgttgcgtctcttggcttgttacaatatcctcacttgttcagttcgtactcaacaagatggaaaggttcagagactttatggtttggctactgttgctaa

SEQ ID NO: 15232 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15233 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15234 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15235 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15236 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15237 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgcccaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15238 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagcctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15239 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15240 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15241 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagcaagcaggcgctggagacggtccagcggctgttgccggtgctgtgcccggcccacggcttgctacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15242 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagcaagcaggcgctggagacggtccagcggctgttgccggtgctgtgccaggcccacggcttgctcacgctggacctggtggtcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15243 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagcaagcaggcgctggagacggtccagcggctgttgccggtgctgtgccaggcccacggcttgctaaaggtggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15244 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagcaagcaggcgctggagacggtccagcggctgttgccggtgctgtgccaggcccacggcttgctaaagctggacctggtggtcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15245 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagcaagcaggcgctggagacggtccagcggctgttgccggtgctgtgccaggcccacggcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15246 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15247 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15248 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15249 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15250 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15251 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15252 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactggacctggtgctcaaatttcacctattgaaatcgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15253 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15254 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctgtacctggtgctcaaatgtcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15255 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15256 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 15257 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15258 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15259 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15260 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcatgttacaatatcctcacttgttcagttcgtactcaacaagatggaaaggttcagagactttatggtttggctactgttgctaa

SEQ ID NO: 15261 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15262 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15263 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtcccttggcttgttacaatatcctcacttgttcagttcgtactcaacaagatggaaagattcagagactttatggtttggctactgttgctaa

SEQ ID NO: 15264 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgtttcgtctcttggcttgttacaatatcctcacttgttcagttcgtactcaacaagatggaaagattcagagactttatggtttggctactgttgctaa

SEQ ID NO: 15265 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 15266 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 15267 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcctgttacaatatcctcacttgttcagttcgtactcaacaagatggaaaggttcagagactttatggtttggctactgttgctaa

SEQ ID NO: 15268 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15269 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15270 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctcccaacaaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15271 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctaccaacaactaaccctgatgctccagttatgttggaccgaatgttgcgtctcttggcttgttacaatatcctcacttgttcagttcgtactcaacaagatggaaaggttcagagactttatggtttggctactgttgctaa

SEQ ID NO: 15272 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15273 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15274 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15275 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15276 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttagtactcaacaagatggaaaggttcagagactttatggtttggctactgttgctaa

SEQ ID NO: 15277 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagcgcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15278 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacctggtgctcaaatttcacctattgaaattgcttctcagctcccaataactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15279 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15280 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15281 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacctggtgctcaaatttcacctattgaaattgcttctcagctcccaacaactaaccctgatgcaccagttatgttgcaccgaatgttgcgtctcttggcttgttacaatatcctcacttgttcagttcgtactcaacaagatggaaaggttcagagactttatggtttggctactgttgctaa

SEQ ID NO: 15282 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 15283 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15284 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15285 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15286 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaccaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15287 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15288 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15289 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15290 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagattttatggtttggctactgttgctaa

SEQ ID NO: 15291 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15292 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15293 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15294 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15295 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacactaaagctggacctgatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcaaa

SEQ ID NO: 15296 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaacaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15297 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggatactgttgctaa

SEQ ID NO: 15298 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15299 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15300 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15301 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaattaaagctggacctggtgctcaaatttcacctattgaaattgcttctcagctaccaacaactaaccctgatgcaccagttatgttggaccgaatgttgcgtctcttggctggttacaatatccgcacttgttcagttcgtactcaacaagatggaaaggttcagagactttatggtttggctactgttgctaa

SEQ ID NO: 15302 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15303 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15304 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15305 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15306 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15307 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15308 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15309 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15310 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15311 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaggctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15312 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagcttgacctggtgctcaactttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15313 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctgttgctcaaagttcacctattgaaattgcttcgcagctcccaacaactaaccctgatgcaccagttatgttggaccgaatgttgcgtctcttggcttgttacaatagcctctcttgttcagttcgtactcaacaagatggaaaggttcagagactttatggtttggcgactggtgctaa

SEQ ID NO: 15314 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaattttacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15315 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15316 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15317 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15318 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15319 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15320 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 15321 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagtttcagagactttatggtttggctactgttgctaa

SEQ ID NO: 15322 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgatgctaa

SEQ ID NO: 15323 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15324 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctatgttgctaa

SEQ ID NO: 15325 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgtgctgttcgtactcaacaagatggaaaggttcagagactttatggtttggctactgttgctaa

SEQ ID NO: 15326 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctacgttgctaa

SEQ ID NO: 15327 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 15328 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttcaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 15329 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15330 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15331 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15332 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15333 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15334 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaatggcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgatgctaa

SEQ ID NO: 15335 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgtaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15336 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttcttagctcccaacaactaaccctgatgcaccagttatgttggaccgaatgttgcgtctcttggcttgttacaatatcctcacttgttcagttcgtactcaacaagatggaaagattcagagactttatggtgtggctactgttgctaa

SEQ ID NO: 15337 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 15338 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctctcaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15339 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaagaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15340 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaagcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15341 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15342 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgattcaccagttatgttggaccgaatgttgcgtctcttggcttgttacaatatcctcacttgttcagttcgtactcaacaagatggaaagattcagagactttatggtttggctactgttgctaa

SEQ ID NO: 15343 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 15344 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcatcagttatgttggaccgaatgttgcgtctcttggcttgttacaatatcctcacttgttcagttcgtactcaacaagatggaaaggttcagagactttatggtttggctactgttgctaa

SEQ ID NO: 15345 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 15346 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15347 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15348 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15349 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtttgctaa

SEQ ID NO: 15350 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctctgggcttgttacaatatcctcacttgttcagttcgtactcaacaagatggaaaggttcagagactttatggtttggctactgttgctaa

SEQ ID NO: 15351 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatgctcacttgttcagttcgtactcaacaagatggaaagattcagagactttatggtttggctactgttgctaa

SEQ ID NO: 15352 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15353 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 15354 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggctttttacaatatcctcacttgttcagttcgtactcaacaagatggaaaggttcagagactttatggtttggctactgttgctaa

SEQ ID NO: 15355 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatcgtttggctactgttgctaa

SEQ ID NO: 15356 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgatacaatatcctcacttgttcagttcgtactcaacaagatggaaaggttcagagactttatggtttggctactgttgctaa

SEQ ID NO: 15357 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgtgcagttcgtactcaacaagatggaaaggttcagagactttatggtttggctactgttgctaa

SEQ ID NO: 15358 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagtctttatggtttggctactgttgctaa

SEQ ID NO: 15359 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 15360 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 15361 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgtcgcgtctcttggcttgttacaatatcctcacttgttcagttcgtactcaacaagatggaaaagttcagagactttatggtttggctactgttgctaa

SEQ ID NO: 15362 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggtccagagactttatggtttggctactgttgctaa

SEQ ID NO: 15363 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagacgtgatggtttggctactgttgctaa

SEQ ID NO: 15364 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 15365 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcgtggctttttacagtatcctcacttgttcaggtcgtactcaacaagagggaaagattcagagactttatggtttggcgactgttactaa

SEQ ID NO: 15366 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtcacttggcttgttacaatatcctcacttgttcagttcgtactcaacaagagggaaagattcagagactttatggtttggctactgttgctaa

SEQ ID NO: 15367 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 15368 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 15369 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 15370 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15371 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcacaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15372 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccgacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15373 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacagctaaccctggtgcaccacttatgttggaccgaatgtggcgtctcttggcttgttacaatatcctcacttgttgagttcgtactcaacaagatgcaatggttcagagactttatggtttggcgagtgttgctaa

SEQ ID NO: 15374 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttgcaatatcctcacttgttcagttcgtactcaacaagatggaaagattcagagactttatggtttggctactgttgctaa

SEQ ID NO: 15375 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15376 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15377 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15378 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttcaatatcctcacttgttcagttcgtactcaacaagatggaaaggttcagagactttatggtttggctactgttgctaa

SEQ ID NO: 15379 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 15380 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttgtctactgttgctaa

SEQ ID NO: 15381 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15382 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgtgcagttcgtactcaacaagatggaaaggttcagagacttgatggtttggctactgttgctaa

SEQ ID NO: 15383 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgtcgcgtctcttggcttgttacaatatcctcacttgttcagttcgtactcaacaagatggaaagattcagagactttatggtttggctactgttgctaa

SEQ ID NO: 15384 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttggtacaatatcctcacttgttcagttcgtactcaacaagatggaaaggttcagagactttatggtttggctactgttgctaa

SEQ ID NO: 15385 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttactaa

SEQ ID NO: 15386 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctctcttgttcagttcgtactcaacaagatggaaagattcagagtctttatggtttggctactgttgctaa

SEQ ID NO: 15387 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 15388 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15389 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacccattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15390 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15391 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtactcaaatttcacctattgaaattgcttctcagctaccaacaactaaccctgatgcaccagttatgttggaccgaatgttgcgtctcttggcttgttacaatatcctcacgtgttcagttcgtactcaacaagatggaaagactcagagactttatggtttggctactgttgctaa

SEQ ID NO: 15392 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctcgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15393 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagccggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15394 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagccggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15395 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15396 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15397 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15398 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttagctactgttgctaa

SEQ ID NO: 15399 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15400 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaacctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15401 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaatctggacctggtgctcaaatttcacatgttcaaattgcttctcagcttcctacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15402 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaattttacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15403 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15404 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15405 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15406 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15407 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15408 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 15409 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttgctactgttgctaa

SEQ ID NO: 15410 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttactatatcctcacttgttcagttcgtactcaacaagatggaaagattcagagactttatggtttggctactgttgctaa

SEQ ID NO: 15411 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagcttccaacaactaaccctgatgcaccagtcatgttggaccgaatggtgcgtctcttggcttgttacaatatcctcacttgttcagttcgtactcaacaagatggaaaggttcagagactgtatggtttggctactgttactaa

SEQ ID NO: 15412 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15413 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15414 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagctaccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 15415 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattggaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15416 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctccgctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15417 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcatctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15418 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccagcaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15419 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccagcaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15420 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaataaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15421 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15422 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15423 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 15424 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttacggtttggctactgttgctaa

SEQ ID NO: 15425 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 15426 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15427 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15428 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctctaggcttgttacaatatcctcacttgttcagttcgtactcaacaagatggaaaggttcagagactttatggtttggctactgttgctaa

SEQ ID NO: 15429 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 15430 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttttggtttggctactgttgctaa

SEQ ID NO: 15431 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctta

SEQ ID NO: 15432 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 15433 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaattttgcgtctcttggcttgttacaatatcctcacttgttcagttcgtactcaacaagatggaaagattcagagactttatggtttggctactgttgctaa

SEQ ID NO: 15434 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtcgcttggcttgttacaatatccgcacttgttcagttcgtactcaacaagatggaaagattcagagactttatggtttggctactgttgctaa

SEQ ID NO: 15435 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttacgtctcttggcttgttacaatatcctcacttgttctgttcgtactcaacaagatggaaaggttcagagactttatggtttggctactgttgctaa

SEQ ID NO: 15436 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 15437 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 15438 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagacattatggtttggctactgttgctaa

SEQ ID NO: 15439 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 15440 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctacagttgctaa

SEQ ID NO: 15441 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgtggcgtcacatggcttgttacaatatcctcacttgttcatgtcgtactcaacaagatggaaaggctcagagactttatggtttggctactgttgctaa

SEQ ID NO: 15442 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctat

SEQ ID NO: 15443 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 15444 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaagatcctcacttgttcagttcgtactcaacaagatggaaagattcagagactttatggtttggctactgttgctaa

SEQ ID NO: 15445 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 15446 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagtttgtactcaacaagatggaaagattcagagcctttatggtttggctactgttgctaa

SEQ ID NO: 15447 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15448 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatccaccagttatgttggaccgaatgttgcgtctcttggcttgttacaatatcctcacttgttcagttcgtactcaacaagatggaaaagttcagagcctttatggtttggctactgttgctaa

SEQ ID NO: 15449 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaggttcggagactttatggtttggctactgttgctaa

SEQ ID NO: 15450 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15451 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggagaggttcagagactttatggtttggctactgttgctaa

SEQ ID NO: 15452 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15453 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15454 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15455 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcttactcaacaagatggaaaggttcagagactttatggtttcgctactgttgctaa

SEQ ID NO: 15456 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtcacttggcttgttacaatatcctcacttgttcagttcgtactcaacaagatggaaagattcagagactttatggtttggctactgttgctaa

SEQ ID NO: 15457 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtacagagactttatggtttggctactgttgctaa

SEQ ID NO: 15458 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 15459 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15460 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15461 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 15462 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaattccacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15463 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtcctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15464 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtactcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15465 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagccggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15466 - DNA, 305 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaacaactaaccctgatgcaccagttatgttggaccgaatgttgcgtctcttggcttgttacaatatcctcacttgttcagttcgtactcaacaagatggaaagattcagagactttatggtttggctactgttgctga

SEQ ID NO: 15467 - DNA, 305 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15468 - DNA, 304 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaacaactaaccctgatgcaccagttatgttggaccgaatgttgcgtctcttggcttgttacaatatcctcacttgttcagttcgtactcaacaagatggaaagattcagagactttatggtttggctactgttctaa

SEQ ID NO: 15469 - DNA, 305 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15470 - DNA, 305 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 15471 - DNA, 305 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15472 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttctcctattgaaattgcttctcagctaccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 15473 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15474 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 15475 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15476 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15477 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15478 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctattgaaattgcttctcagctcccaacaactaaccctgatgcaccagttatgttggaccgaatgttgcgtctcttggctggttacaatatcctcacttgttcatttcgtactcaacaagatggaaagattcagagactttatggtttggctactgttgctaa

SEQ ID NO: 15479 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15480 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15481 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 15482 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 15483 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15484 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15485 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 15486 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15487 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctattgaaatcgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15488 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctgatgctcaaatttcacctattgaaattgcttctcagctcccaacaactaaccctgatgccccagttatgttggaccgaatgttgcgtctcttggcttgttacaatatcctcacttgttaagtacgtactcaacaagatggaatggttcagcgactttatggttttgctactgttgctaa

SEQ ID NO: 15489 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacccggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15490 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttactaaagctggacctggtgctcaaatttcacctattgaaattgcttctcagctcccaacaactaaccctgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 15491 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15492 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15493 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttactaaagctggacctggtgctcaaatttcacctattgaaattgcttctcagctcccaacaactaaccctgatgcaccagttatgttggaccgaatgttgcgcctcttggcttgttacaatatcctcacttgttcagttcgtactcaacaagatggaaaggttcagagactttatggtttggctactgttgctaa

SEQ ID NO: 15494 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15495 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15496 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15497 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15498 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15499 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15500 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 15501 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15502 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15503 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15504 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaataaagctggacctggtgctcaaatttcacctattgaaattgcttctcagctcccatcaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15505 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15506 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15507 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15508 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15509 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcgaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15510 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcatatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15511 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15512 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15513 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15514 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 15515 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15516 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctgttcaaattgcttctcagctcccaacaactaaccctgatgcaccagttatgttggaccgagtgttgcgtctcttggcttgttacaatatcctcacttgttcagttcgtactcaacaagatggaaaggttcagagactttatggtttggctactgttgctaa

SEQ ID NO: 15517 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15518 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15519 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15520 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15521 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15522 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgttctcaacaagatggaaaggttcagagactttatggtttggctactgttgctaa

SEQ ID NO: 15523 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttgtggtttggctactgttgctaa

SEQ ID NO: 15524 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15525 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctctcttgttcagttcgtactcaacaagatggaaaggttcagagactttatggtttggctactgttgctaa

SEQ ID NO: 15526 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15527 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatctcctcacttgttcagttcgtactcaacaagatggaaaggttcagagcctttatggtttggctactgttgctaa

SEQ ID NO: 15528 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 15529 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctat

SEQ ID NO: 15530 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgct

SEQ ID NO: 15531 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15532 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15533 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15534 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 15535 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctgatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15536 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagcttgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 15537 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagcttgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15538 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgttcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15539 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgcttaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15540 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcacatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15541 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15542 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15543 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15544 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15545 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15546 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctgttcaaattgcttctcagcttccaacaactaaccctgatgcaccagtcatgttggaccgaatgttgcgtctcttggcttgttgcaatatcctcacttgttctgttcgtactcaacaagatggaaaggttcagagactttatggtttggctactgttgctaa

SEQ ID NO: 15547 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 15548 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctgttcaaattgcttctcagcttcaaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15549 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15550 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15551 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttcttagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15552 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15553 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccatcaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15554 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactgaccctgatgcaccagttatgttggaccgaatgttgcgtctcttggcttgttacaatatcctcacttgttcagttcgtactcaacaagatggaaagattcagagactttatggtttggctactgtagctaa

SEQ ID NO: 15555 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcatcagttatgttggaccgaatgttgcgtctcttggcttgttacaatatcctcacttgttcagttcgtactcaacaagatggaaagattcagagactttatggtttggctactgttgctaa

SEQ ID NO: 15556 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttgtgttggaccgaatgttgcgtctcttggcttgttacaatatcctcacttgttcagttcgtactcaacaagatggaaagattcagagactttatggtttggctactgttgctaa

SEQ ID NO: 15557 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15558 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15559 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 15560 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagtccgtactcaacaagatggaaagattcagagactttatggtttggctactgttgctaa

SEQ ID NO: 15561 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15562 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcaggtcgtactcaacaagatggaaaggttcagagactttatggtttggctactgttgctaa

SEQ ID NO: 15563 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaagagttcagagactttatggtttggctactgttgctaa

SEQ ID NO: 15564 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaaccagatggaaagattcagagcctttatggtttggctactgttgctaa

SEQ ID NO: 15565 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaaccagatggaaagattcagagactttatggtttggctactgttgctaa

SEQ ID NO: 15566 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 15567 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15568 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 15569 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagacttcatggtttggctactgttgctaa

SEQ ID NO: 15570 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 15571 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactattgctaa

SEQ ID NO: 15572 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgca

SEQ ID NO: 15573 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatctcctcacttgttcagttcgtactcaacaagatggaaagattcagagactttatggtttggctactgttgctaa

SEQ ID NO: 15574 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactttgctaa

SEQ ID NO: 15575 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttgccttgttacaatatcctcacttgttcagttcgtactcaacaagatggaaagattcagagactttatggtttggctactgttgctaa

SEQ ID NO: 15576 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 15577 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggagagattcagagactttatggtttggctactgttgctaa

SEQ ID NO: 15578 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttggtacaatatcctcacttgttcagttcgtactcaacaagatggaaaggttcagagactttatggtttggctactgttgctaa

SEQ ID NO: 15579 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcttctcttggcttgttacaatatcctcacttgttaagttcgtactcaacaagatggaaaggttcagagactttatggtttggctactgttgctaa

SEQ ID NO: 15580 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctctttgcttgttacaatttcctcacttgttcagttcgtactcaacaagatggaaagattcagagactttatggtttggctactgttgctaa

SEQ ID NO: 15581 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 15582 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatttcctcacttgttcagttcgtactcaacaagatggaaaggttcagagactttattgtttggctactgttgctaa

SEQ ID NO: 15583 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaaagttcagagactttatggtttggctactgttgctaa

SEQ ID NO: 15584 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15585 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 15586 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 15587 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15588 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15589 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaaccactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15590 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15591 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggacctaatgttgcgtcgcttggctttttacaatatcctcacttgttcagttcgtactcaacaagatggaaagattcagagactttatgatttggctactgttgctaa

SEQ ID NO: 15592 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15593 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15594 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15595 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15596 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggcactgttgctaa

SEQ ID NO: 15597 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctgctgttgctaa

SEQ ID NO: 15598 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 15599 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 15600 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgctgctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15601 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttaacctattgaaattgcttctcagctcccaacaactaaccctgatgcaccagttatgttggaccgaatgttgcgtctcttggattgttacaatatcctcacttgttcagttcgtactcaacaagatggaaagattcagagcctttatggtttggctactgttgctaa

SEQ ID NO: 15602 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15603 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggagctcaaatttcacctattgaaattgcttctcagctcccaacaactaaccctgatgcaccagttatgttggaccgaatgttgcgtctcttggcttgttacaatatcctcacttgtgcagttcgtactcaacaagatggaaagattcagagactttatggtttggctactgttactaa

SEQ ID NO: 15604 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctagtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15605 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacccggtgctcaaatttcgcctattgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 15606 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacccggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15607 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15608 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaaagctggacctggtgctcaaatttcacctattgaaattgcttctcagctcccaacaactaaccctgatgcaccagttatgttggaccgaatgttgcgtctcttggcttgttacaatatcctcacttgtttagttcgtactcaacaagatggaaaggttcagagactttatggtttggctactgttgctaa

SEQ ID NO: 15609 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15610 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttcgctactgttgctaa

SEQ ID NO: 15611 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15612 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15613 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15614 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15615 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15616 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15617 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15618 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15619 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15620 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggtgcagagactttatggtttggctactgtttaa

SEQ ID NO: 15621 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15622 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggtgctcaaatttcacctattgaaattgcttctcagctcccaacaactaaccctgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 15623 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15624 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15625 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15626 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggacctggtgctcaaatttcacctgttcaaattgcttctcagcttccaacaactaaccctgatgcaccagttatgttggaccgaatgttgcgtctctttgcttgttacaatatcctcacttgttcagttcgtactcaacaagatggaaaggttcagagactttatggtttggctactgttgctaa

SEQ ID NO: 15627 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15628 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15629 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggacctggtgctcaaatttcacctattgaaattgcttctcagctcgcaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15630 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15631 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15632 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15633 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgggaagattcagagactttatggtttggctactgttgctaa

SEQ ID NO: 15634 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggacctggtgctcaaatttcacctattgaaattgcttctcagctcccaacaactaaccctgatgcaccagtcatgttggaccgaatgttgcgtctcttggcttgttacaatatcctcacttgttcttttcgtactcaacaagatgtaaacgttcagagactttatggtttcgctactgttgctaa

SEQ ID NO: 15635 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggacctggtgctcaaatttcacctattgaaattgcttctcagctaccaacaactaaccctgatgcaccagttatgttggaccgaatgttgcgtctctggacttgttacaatagcctcactggttcagttcgtactcaacaagatggaaaggttcagagactgtatggtttggctactgttgctaa

SEQ ID NO: 15636 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15637 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15638 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15639 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15640 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15641 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatgaaaaggttcagagactttatggtttggctactgttgctaa

SEQ ID NO: 15642 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15643 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15644 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 15645 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctcagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15646 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctcagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15647 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctcagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15648 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctcagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15649 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctcagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15650 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctcagaaacataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15651 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctcagaaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15652 - DNA, 322 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15653 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15654 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15655 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15656 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaagattcagagactttatggtttggctactgttgctaa

SEQ ID NO: 15657 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15658 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15659 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15660 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15661 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15662 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 15663 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15664 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttctgagactttatggtttggctactgttgctaa

SEQ ID NO: 15665 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15666 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcactagttatgttggaccgaatgttgcgtctcttggcttgttacaatatcctcacttgttcagttcgtactcaacaagatggaaagattcagagactttatggtttggctactgttgctaa

SEQ ID NO: 15667 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggactgaatgttgcgtctcttggcttgttacaatatcctcacttgttcagttcgtactcaacaagatggaaagattcagagactttatggtttggctactgttgctaa

SEQ ID NO: 15668 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15669 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15670 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 15671 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15672 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggctagttacaatatcctcacttgttcagttcgtactcaacaagatggaaaggttcagagactttatggtttggctactgtggctaa

SEQ ID NO: 15673 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15674 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtttgctaa

SEQ ID NO: 15675 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtgctaa

SEQ ID NO: 15676 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcatctcttagcttgttacaatatcctcacttgttcagttcgtactcaacaagacggaaagattcagagactttatggtttggctactgttgctaa

SEQ ID NO: 15677 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcatctcttggcttgttacaatatcctcacttgttcagttcgtactcaacaagatggaaaggttcagagactttatggtttggctactgttgctaa

SEQ ID NO: 15678 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcatcaagatggaaaagttcagagactttatggtttggctactgttgctaa

SEQ ID NO: 15679 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 15680 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 15681 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgctggaccgaatgttgcgtctcttggcttgttacaatatcctcacttgttcagttcgtactcaacaagatggaaagattcagagactttatggtttggctactgttgctaa

SEQ ID NO: 15682 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15683 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15684 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15685 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatacaccagttatgttggaccgaatgttgcgtctcttggcttgttacaatatcctcacttgttcagttcgtactcaacaagatggaaagattcagagactttatggtttggctactgttgctaa

SEQ ID NO: 15686 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctaccaacaactaaccctggtgcaccagttatgttggaccgaatgttgcgtctcttggcttgttacaatatcctcacttgttcagttcgtactcaacaagatggaaaggttcagagactttatggtttggctactgttgctaa

SEQ ID NO: 15687 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15688 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15689 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15690 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15691 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagtgcgtactcaacaagatggaaaggttcagagactttatggtttggctactgttgctaa

SEQ ID NO: 15692 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 15693 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggcgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15694 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctgatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15695 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctgcacctggtgctcaaatttcacctattgaaattgcttctcagctcccaaccactacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15696 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcggcttgaccccggagcaggtggtggccatcgccagcaatattggtggcaagcaggcgctggagacggtgcagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatgggaaggttcagagactttatggtttggctactgttgctaa

SEQ ID NO: 15697 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcgctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15698 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15699 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15700 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcgctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15701 - DNA, 413 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcctagaaatcgtggggcacgtacttcagcttgtgcctcaactcggatttcttctcctccagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15702 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcctagaaatcaacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15703 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcctagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15704 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcattaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15705 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15706 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15707 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15708 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15709 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15710 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcaagctggacctggtgctcaaatttctcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15711 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15712 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15713 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15714 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctattagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15715 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacctggtgctcaaatttcacctgttcaaattgcttctcagcttccaacaactaaccctgatgcaccagtcatgttggaccgaatgttgcgtctcttggcttgttacaatatcctcacttgttcagttcgtacccaacaagatggaaaagttcagagactttatggtttggctactgttgctaa

SEQ ID NO: 15716 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15717 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15718 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15719 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggttcggctactgttgctaa

SEQ ID NO: 15720 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 15721 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15722 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15723 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacctggtgctcaaatttcacctagtgaaattgcttctcagctaccaacaactaaccctgatgcaccagttatgttggaccgaatgttgcgtctcttggcttgttacaatatcctcacttgttcagttcgtactcaacaagagggaaaggttcagagactttatgggttggctactgttgctaa

SEQ ID NO: 15724 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15725 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15726 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15727 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15728 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15729 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15730 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15731 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15732 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15733 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15734 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctaccgttgctaa

SEQ ID NO: 15735 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctgttcaaattgcttctcagcttccaacaactaaccctgatgcaccagtcatgttggaccgaatgttgcgtctcttggcttgttacaatatcctcacttgtgctgttcgtactcaacaagatggaaaggttcagagactttatggtttggctactttgctaa

SEQ ID NO: 15736 - DNA, 351 bp, Artificial
  MsCOMT deletion introduced by TALEN pair MsCOMT_T02.1
  misc_feature (351): n is a or c or t or g
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgcttan

SEQ ID NO: 15737 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15738 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctgttcaaattgcttctcagcttccaacaactaaccctgatgcaccagtcatgatggaccgaatgttgcgtctcttggcttgttacaatatcctcacttgttctgttcgtactcaacaagatggaaaggttcagagactttatggtttggctactgttgctaa

SEQ ID NO: 15739 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctgttcaaattgcttctcagcttccaacaactaaccctgatacaccagtcatgttggaccgaatgttgcgtctcttggcttgttacaatatcctcacttgttctgttcgtactcaacaagatggaaaggttcagagactttatggtttggctactgttgctaa

SEQ ID NO: 15740 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15741 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctgttcaaattgcttctcagctcccaacaactaaccctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 15742 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctgttcaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15743 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15744 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15745 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15746 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15747 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttacggtttggctactgttgctaa

SEQ ID NO: 15748 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 15749 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctccaaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15750 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctaccaacaactaaccctgatgcactagttatgttggaccgaatgttgcgtctcttggcttgttacaatatcctcacttgttcagttcgtactcaacaagatggaaaagttcagagactttatggtttggctactgttgctaa

SEQ ID NO: 15751 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctaccaacaactaaccctgatgcaccagttatgtttgaccgaatgttgcgtctcttggcttgttacaatatcctcacttgtgcagttcgtactcaacaagatggaaaggttcagagactttatggtttggctactgttgctaa

SEQ ID NO: 15752 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15753 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15754 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15755 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 15756 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15757 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctaacttgttcagttcgtactcaacaagatggaaaggttcagagactttatgggttggctaactgttgctaa

SEQ ID NO: 15758 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 15759 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15760 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15761 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15762 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15763 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15764 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15765 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15766 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcctggacctggtgctcaaatttcacctattgaaattgcttctcagctcccaacaactaaccctgatgcaccagttatgttggaccgaatgttgcgtctcttggcttgttacaatatcctcacttgtgcagttcgtactcaacaagatggaaaggttcagagactttatggtttgctactgttgctaa

SEQ ID NO: 15767 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactttgctaa

SEQ ID NO: 15768 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15769 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15770 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15771 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15772 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcccttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15773 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcccttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15774 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcccttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15775 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatccctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15776 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15777 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatatcttagaaatcatgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15778 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatatcttagaaatcagctggacctggtgctcaaatttcacctattgaaattgcttctcagctcccaacaactaaccctgatgcaccagttatgttggaccgaatgtttcgtctcttggcttgttacaatatcctcacttgtttatttcgtactcaacaagatggaaaggttcagagactttatggtttgctactgttgctaa

SEQ ID NO: 15779 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatatcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15780 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15781 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15782 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatagctggacctggtgctcaaatttcacctattgaaattgcttctcagctgccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15783 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15784 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatagctggacctggtgctcaaatttcacctattgaaattgcttctcagctcccaacaactaaccctgatgcaccagttatgttggaccgaatgttgcgtctcttggcttgttacaatatcctctcttgttcagttcgtactcaacaagatggaaagattcagagactttatggtttggctactgttgctaa

SEQ ID NO: 15785 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15786 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15787 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15788 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15789 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgataaagctggacctggtgctcagatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagacttcatggtttggctactgttgctaa

SEQ ID NO: 15790 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgataaagctggacctggtgctcaaatttcgcctattgaaattgcttctcagctcccaacaactaaccctgatgcaccagttaggttggaccgaatgttgcgtctcttggcttgtgacaatatcctcacgtgttcagttcgtactcaacaagagggaaaggttcagagactttatggtttggctactgttgctaa

SEQ ID NO: 15791 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15792 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgataaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15793 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15794 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15795 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15796 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 15797 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactttgctaa

SEQ ID NO: 15798 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15799 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgataaagctggacctggtgctcaaatttcacctattgaaattgcttctcagctcccaacaactaaccctgatgcaccagttatgttggaccgaatcttgcgtctcttggcttgttacaatatcctcacttgttcagttcgtactcaacaagatggaaaggttcagagactttatggtttggctactgttgctaa

SEQ ID NO: 15800 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15801 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15802 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15803 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgataaagctggacctggtgctcaaattgcacctattgaaattgcttctcagctcccaacaactaaccctgatgcaccagtcatgttggaccgaatgttgcgtctcttggcttgttacaatatcctcccttgttcagttcgtactcaacaagatggaaagattcagagactttatggtttggctactgttgctaa

SEQ ID NO: 15804 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15805 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15806 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgagcagctggacctggtgctcaaatttcacctattgaaattgcttttcagcttccaacacctaaccctgatgcaccagttatgttggaccgaatgttgcgtctcttggctggtaacagtttcctcacttgttcagtccttcctaaacaagatgaaaagtttcagggacttaatggtttgctactgttgctaa

SEQ ID NO: 15807 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15808 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgacctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15809 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15810 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15811 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaagattcagagactttatggtttggctactgttgctaa

SEQ ID NO: 15812 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15813 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgaactcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15814 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 15815 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15816 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15817 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgaaagctgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 15818 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15819 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15820 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttcatctcttagaaattaacgctggacctggtgctcaaagttcacctattgaaattgcttctcagctcccaacaactaaccctgatgcaccagttatgtgggacagaatgttgcgtctcttggcttgttacaatatcctcacttgttcagttcgtactcaacaagatggaaagattcagagactttatggtttggctactgttgctaa

SEQ ID NO: 15821 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15822 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15823 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 15824 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttagctggacctggtgctcaaatttcacctgttcaaattgcttctcagcttccaacaactaaccctgatgcaccagtcatgttggaccgaatgttgcgtctcttggctggttacaatatcctcacttgttctgttcgtactcaacaagatggaaaggttcagagactttatggtttggctactgttgctaa

SEQ ID NO: 15825 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 15826 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15827 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15828 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttagctggacctggtgctcaaatttcacctgttcaaattgcttctcagcttccaacaactaaccctgatgcaccagtcatgttggaccgaatgttgcgtctctaggctggttacaatatcctcacttgtgctgttcgtactcatcaagacggaaaggttcagagactttatggtttggctactgttgagaa

SEQ ID NO: 15829 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15830 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttagctggacctggtgctcaaatttcacctgttcaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 15831 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttagctggacctggtgctcaaatttcacctattgaaattgcttctcagctcccaacaactaaccctgatgtaccagttatgttggaccgaatgttgcgtctcttggcttgttacaatatcctcacttgttcagttcgtactcaacaagatggaaagattcagagactttatggtttggctactgttgctaa

SEQ ID NO: 15832 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15833 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15834 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15835 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15836 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15837 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15838 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 15839 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15840 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15841 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaaagcttgacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15842 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15843 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15844 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctgttcaaattgcttctcagcttccaacaactaaccctgatgcaccagtcatgtttgaccgaatgttgcgtctctttgcttgttacaatatcctcacttgttcagttcgtactcaacaagatggaaaggttcagagactttatggtttggctactgttgctaa

SEQ ID NO: 15845 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctgttcaaattgcttctcagcttccaacaactaaccctgatgcaccagtcatgttggactgaatgttgcgtctcttggcttgttacaatatcctcacttgttcagttcgtactcaacaagatggaaaggttcagagactttatggtttggctactgttgctaa

SEQ ID NO: 15846 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15847 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15848 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15849 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15850 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15851 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15852 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15853 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15854 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15855 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15856 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15857 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15858 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactctggacctggtgctcaaatttcacctattgaaattgcttctcagctcccaacaactaaccctgatgcaccagttatgttggaccgaatgttgcgcctcttggcttgttacaatatcctcacttgttcagttcgtactcaacaagatggaaagattcagagactttatggtttggctactgttgctaa

SEQ ID NO: 15859 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15860 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15861 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactcgatctcttagacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 15862 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactcgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15863 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactcgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15864 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactcgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15865 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactcgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15866 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactcgatctcttagaaaaagctggacctggtgctcaaatttcacctattgaaattgcttctcagctcccaacaactaaccctgatgcaccagttatgttggacagaatgttgcgtctcttggcttgttacaatatcctcacttgttcagttcgtactcaacaagatggaaaagttcagagactttatggtttggctactgttgctaa

SEQ ID NO: 15867 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactcgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15868 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactagatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15869 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcgcctattgaaattgcttctcagctcccaacaactaaacctgatgcaccagttatgttggaccggatgttgcgtctcttggcttgttacaatatcctcacatgttcagttcgtactcaacaagatggaaaggttcagagactttatggataggctgatgttgctaa

SEQ ID NO: 15870 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15871 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15872 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctgttcaaattgcttctcagcttccaacaactaaccctgatgcaccagtcatgttggaccgaatgttgtgtctcttggcttgttacaatatcctcacttgttctgttcgtactcaacaagatggaaaggttcagagactttatggtttggctactgttgctaa

SEQ ID NO: 15873 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15874 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15875 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15876 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 15877 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15878 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctgttcaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15879 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15880 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15881 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15882 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggtacagagcctttatggtttggctactgttactaa

SEQ ID NO: 15883 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctattgaaattgcttctcagctcccaacaactaaccctgatgcaccagttatgttggaccgaatgttgcatctcttggcttgttacaatatcctcacttgttctgttcgtactcaacaagatggaaaggttcagagactttatggtttggctactgttgctaa

SEQ ID NO: 15884 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15885 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaagttcagagactttatggtttggctactgttgctaa

SEQ ID NO: 15886 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15887 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15888 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactaaagctggacctggtgctcaaatttcacctatcgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 15889 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15890 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15891 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacctgatctcttagaaatgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15892 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacctgatctcttagaaatgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15893 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacctgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgcta

SEQ ID NO: 15894 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacctgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15895 - DNA, 295 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15896 - DNA, 295 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15897 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15898 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15899 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15900 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15901 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaaaagatggaaagattcagagactttatggtttggctactgttgctaa

SEQ ID NO: 15902 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacatgatctcttaggctaaagctggacctggtgctcaaatttcacctgttcaaattgcttctcggcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 15903 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacatgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15904 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15905 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15906 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15907 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15908 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15909 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15910 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15911 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15912 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15913 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15914 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15915 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaaccagatggaaacgttcagagactttatggtttggctactgttgctaa

SEQ ID NO: 15916 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15917 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15918 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15919 - DNA, 335 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttctggacctggtgctcaaatttcacctattgaaattgcttctcagctcccaacaactaatcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15920 - DNA, 335 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15921 - DNA, 335 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15922 - DNA, 335 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15923 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15924 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15925 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttaaacttgatctcttagaattaagcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15926 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttaaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15927 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttaaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15928 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctggaacttgatctcttagaaatctaaagctggacctggtgctcaaatttcacctattgaaattgcttctcagctcccaacaactaaccctgattcaccagttatgttggaccgaatgttgcgtctcttggcttgttacaatatcctcacttgttcagttcgtactcaacaagatggaaagattcagagactttatggtttggctactgttgctaa

SEQ ID NO: 15929 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15930 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15931 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15932 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15933 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15934 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15935 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15936 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15937 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcattaaagctggacctggtgctcaaatttcacctattgaaattgcttctcagctcccaacaactaaccctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 15938 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcgtgaacttgatctcttagaaatttaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15939 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcgtgaacttgatctcttagaaatcactaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15940 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcctgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15941 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcctgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15942 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcctgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15943 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcctgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15944 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcatgaacttgatctcttagaaatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15945 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctattgaacttgatctcttagaaataaagctggacctggtgctcaaatttcacctattgaaattgcttctcagctcccaacaactaaccctgatgcaccagttatgttggaccaaatgttgcgtctcttgtcttgttacaatatcctcacttgttcagttcgtactcaacaagatgtaaagattcagagactttatggtttggctactgttgctaa

SEQ ID NO: 15946 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctattgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15947 - DNA, 336 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15948 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagcccttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15949 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagcccttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15950 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagcccttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15951 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagcccttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15952 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagatcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 15953 - DNA, 447 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcacttgaaggcggtaatacggttatccacagaatcaggggataacgcaggaaagaacatgtgagcaaaaggccagcaaaaggccaggaaccgtaaaaaggccgcgttgctggcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15954 - DNA, 447 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcacttgaaggcggtaataaggttatccacagaatcaggggaaaacgcaggaaagaacatgtgagcagaaggccagcaaaaggcaaggaaccgtaaaaaggccgcgttgctggcgctaaagctggacctggtgctcaaatttcccctattgaaattgcttctcagcacccaactactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15955 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15956 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15957 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 15958 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15959 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15960 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 15961 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15962 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15963 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcaactcttgaacttgatctcttagaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 15964 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcaactcttgaacttgatctcttagaaaagctggacctggtgctcatatttcacctattgaaattgcttctcagctaccaacaactaaccctgatgcaccagttatgttggaccgaatgttgcgtctcttggctttttacaatatcctcacttgttcagttcgtactcaacaagatgtaaatgttcagagactttatggtttggctactgttgctaa

SEQ ID NO: 15965 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcaactcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15966 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcaactcttgaactaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15967 - DNA, 329 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatagctggacctggtgctcaaatttcacctattgaaattgcttctcagctcccaacaactaaccctgttgcaccagttatgttggaccgaatgttgcgtctcttggcttgttacaatatcctcacttgttcagttcgtactcaacaagatggaaaggttcagagactttatggtttggctactgttgctaa

SEQ ID NO: 15968 - DNA, 329 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15969 - DNA, 329 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15970 - DNA, 330 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatgggttggctactgttgcttaa

SEQ ID NO: 15971 - DNA, 329 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatagctggacctggtgctcaaatttcacctattgaaattgcttctcagctcccaacaactaaccctgatgcaccagttatgttggaccgaatgttgcgtctcttggcttgttacaatatcctcacttgttcagttcgcactcaacaagatggaaaggttcagagcctttatggtttggctactgttgctaa

SEQ ID NO: 15972 - DNA, 329 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15973 - DNA, 329 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15974 - DNA, 329 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 15975 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaataagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15976 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaaccagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15977 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaaccagctcttgaacttgatctcttagaaatcaaagctggacctggtgctcaaatttcacctattgaaattgcttctcagcgcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 15978 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaaatcgtggctggcgatggcccccacctgctccggggtcaagccgtgggcctggcacagcaccggcaacagccgctggaccgtctccagcgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15979 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaaatcgtggctggcgatggccaccacctgctccggggtcaagccgtgggcctggcacagccccggcaacagccgctggaccgtctccagcgctaaagctggacctggtgctcaaattgcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15980 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaaatcgtggctggcgatggccaccacctgctccggggtcaagccgtgggcctggcacagcactggcaacagccgctggaccgtctccagcgctaaagctggacctggtgctcaaatttcacctattgaaattgcttctcagctcccaacaactatccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15981 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaaatcgtggctggcgatggccaccacctgctccggggtcaagccgtgggcctggcacagcaccggcaacagccgctggaccgtctccagcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15982 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaaatcgtggctggcgatggccaccacctgctccggggtcaagccgtgggcctggcacagcaccggcaacagccgctggaccgtctccagcgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 15983 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaaatcgtggctggcgatggccaccacctgctccggggtcaagccgtgggcctggcacagcaccggcaacagccgctggaccgtctccagcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15984 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctctttgcttgttacaatatcctcacttgttcagttcgtactcaacaagatggaaaggttcagagactttatggtttggctactgttgctaa

SEQ ID NO: 15985 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttcgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15986 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttcgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15987 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttcgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15988 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttcgaaatcagctcttgaacttgatctcttagaaatacaatatcctcacttgttcagttcgtactcaacaagatggaaaagttcagagactttatggtttggctactgttgctaa

SEQ ID NO: 15989 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttcaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15990 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttcaaaatcagctcttgaacttgatctcttagaaatcattccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15991 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttcaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15992 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttcaaaatcagctcttgaacttgatctcttagaaagctaaagctggacctggtgctcaaatttcacctgttcaaattgcttctcagcttccaacaactaaccctgatgcaccagtcatgttggaccgaatgttgcgtctcttggcttgttacaatatcctcacttgtgctgttcgtactcaacaagatggaaaggttcagagactttatggtttggctactgttgctaa

SEQ ID NO: 15993 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttagaaatcagctcttgaacttgatctcttagaaatcattgctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15994 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaatcagctcttgaacttgatctcttagaaatggacctcgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15995 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15996 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15997 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 15998 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 15999 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16000 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16001 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16002 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaaatcagctcttgaacttgatctcttagaaatcatggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16003 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16004 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16005 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattgtgaaatcagctcttgaacttgatctcttagaaataaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16006 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattgtaaaatcagctcttgaacttgatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16007 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattgtaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16008 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattgtaaaatcagctcttgaacttgatctcttagaaatcagcaatggcggcggcaggccggcgctggctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 16009 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattctaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16010 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattataaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16011 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattataaaatcagctcttgaacttgatctcttagaaataagctggacctggtgctcaaatttcacctattgaaattgcttctcagctcccaacaactaaccctgatgcaccagttatgttggaccgaatgttgcggcacttggcttgttacaatatcctcacttgttcagttcgtactcaacaagatggaaaagttcagagactttatggtttggctactgttgctaa

SEQ ID NO: 16012 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattataaaatcagctcttgaacttgatctcgctggacctggtgctcaaatttcacctattgaaattgcttctcagctcccaacaactaaccctgatgcaccagttatgttggaccgaatgtttcctctctttggttgttacaatatcctcacttgttcagttcgtactcaacaagatggaaagattcagagactttatggtttggctactgttgctaa

SEQ ID NO: 16013 - DNA, 323 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgataaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16014 - DNA, 323 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16015 - DNA, 323 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16016 - DNA, 323 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16017 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgactttaaaatcagctcttgaacttgatctctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16018 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaatttaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16019 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaatttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16020 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcggctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16021 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctcccaacaactaaccctgatgcaccagttatgtttgaccgaatgttgcgtctcttggcttgttacaatatcctcacttgttcagttcgtactcaacaagatggaaaggttcagagactttatggtttggctactgttgctaa

SEQ ID NO: 16022 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctcccaacaactaaccctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 16023 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16024 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctcccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 16025 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 16026 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16027 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16028 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgcaaa

SEQ ID NO: 16029 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctcccaacaactaaccctgatgcaccagttatgttggaccgaatgttgcgtctcttggcttgttacaatatcctcactcgttcagttcgtactcaacaagatggaaaggttcagagactttatggtttggctactgttgctaa

SEQ ID NO: 16030 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctcccaacaactaaccctgatgcaccagttatgatggaccgaatgttgcgtctcttggcttgttacaatatcctcacttgttcagttcgtactcaacaagatggaaaggttcagagactttatggtttggctactgttgctaa

SEQ ID NO: 16031 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16032 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16033 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16034 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16035 - DNA, 302 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16036 - DNA, 302 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16037 - DNA, 302 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16038 - DNA, 302 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16039 - DNA, 302 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16040 - DNA, 302 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16041 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccataattttaaaatcagctcttgaacttgatctcttagaaataagctggacctggtgctcaaatttcacctattgaaattgcttctcagctcccaacaactaaccctgctgcaccagttatgttggaccgaatgttgcgtctattggcttgttacaatatcctcacttgttcagttcgtactcaaaaagatggaaaggttcagagactttatggtttggatactgttgctaa

SEQ ID NO: 16042 - DNA, 260 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccataaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16043 - DNA, 260 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccataaccctgatgcaccagttatgttggaccgaatgttgcgtctcttggcttgttacaatatcctcacttgttcagttcgtactcatcaagatggaaaggttcagagactttatggtttggctactgttgctaa

SEQ ID NO: 16044 - DNA, 260 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16045 - DNA, 260 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccataaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16046 - DNA, 260 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccataaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16047 - DNA, 260 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccataaccctgatgcaccagttatgttggaccgaatgttgcgtctcttggcttgttacaatatcctcacttgttcagttcatactcaacaagatggaaagattcagagactttatggtttggctactgttgctaa

SEQ ID NO: 16048 - DNA, 260 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccataaccctgatgcaccagttatattggaccgaatgttgcgtctcttggcttgttacaatatcctcacttgttcagttcgtactcaacaagatggaaaggttcagagactttatgttttggctactgttgctaa

SEQ ID NO: 16049 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccacgattttgaaatcagctcttgaacttgatctcttagaagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16050 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccacgattttaaaatcagctcttgaacttgatctcttagaatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16051 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccacgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16052 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccacgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16053 - DNA, 353 bp, Artificial
  MsCOMT deletion introduced by TALEN pair MsCOMT_T02.1
  misc_feature (353): n is a or c or t or g
tctcacaaaaacctcatcaatcacaaccatgggttcaacaggtgaaactcaaataacaccaacccacatatcagatgaagaagcaaacctcttcgccatgcaattagcaagtgcttcagttcttcccacgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctan

SEQ ID NO: 16054 - DNA, 302 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccaccaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16055 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccaagattttaaaatcagctcttgaacttgatctcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16056 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccaagattttaaaatcagctcttgaacttgatctcttagaaattaaagctggacctggtgctcaaatttcacctgttcaaattgcttctcagcttccaacaactaaccctgatgcgccagtcatgttggaccgaatgttgcgtctcttggcttgttacaatatcctcacttgttctgttcgtactcaacaagatggaaaggttcagagactttatggtttggctactgttgctaa

SEQ ID NO: 16057 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaagattcagagactttatggtttggctactgttgctaa

SEQ ID NO: 16058 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16059 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttgaaatcagctcttgaacttgatctcttagaaataaagctggacctggtgctcaaatttcacctattgaaattgcttctcagctaccaacaactaaccctgatgcgccagttatgttggaccgaatgttgcgtctcttggcttgttacaatatcctcacttgttcagttcgtactcaacaagatggaaaagttcagagactttatggtttggctactgttgctaa

SEQ ID NO: 16060 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16061 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagactaaagctggacctggtgctcaaatttcacctattgaaattgcttctcagctcccaacaactacccctgatgcaccagttatgttggaccgaatgttgcgtctcttggcttgttacaatatcctcacttgttcagttcgtactcaacaagatggaaagattcagagactttatggtttcgctactgttgctaa

SEQ ID NO: 16062 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaatctaagctggacctggtgctcaaatttcacctatttaaattgcttctcagctcctaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16063 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16064 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaatcattgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16065 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaatcatgctggacctggtgctcaaatttcacctattgaaattgcttctcagctaccaaccactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16066 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaatcataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgtagctaa

SEQ ID NO: 16067 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaatcaagctggacctggtgctcaaattttacctattgaaattgcttctcagctcccaacagctaaccctgatgcaccagttatgttggaccgaatgttgcgtctcttggcttgttacaatttcctcacttgttcagttcgtactcaacaagatggaatggttcagagactttatggtttggctactgttgctaa

SEQ ID NO: 16068 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16069 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgtaa

SEQ ID NO: 16070 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16071 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16072 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16073 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaaaagctggacctggtgctcaaatttctcctattgaaattgcttcgcagctaccaacaactaaccctgatgcaccagttatgttggaccgaatgttgcgtctcttggtttgttacaatatcctcacttgttcagttcgtactcaacaagatggaaaagttcagagactttatggtttggctactgttgctaa

SEQ ID NO: 16074 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16075 - DNA, 290 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16076 - DNA, 290 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcacctattgaaattgcttctcagctcccaacaactaaccctgatgcaccagttatgttggaccgaatgttgcgtctcttggcttgttacaatatccttacttgttcagttcgtactcaacaagatggaaaggttcagagactttatggtttggctactgttgctaa

SEQ ID NO: 16077 - DNA, 290 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16078 - DNA, 290 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggcttggctactgttgctaa

SEQ ID NO: 16079 - DNA, 290 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16080 - DNA, 290 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16081 - DNA, 290 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggatactgttgctaa

SEQ ID NO: 16082 - DNA, 290 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 16083 - DNA, 290 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16084 - DNA, 290 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16085 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcacatgattttaaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16086 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcacatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16087 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcacatgattttaaaatcagctcttgaacttgatctcttagaaatttaaagctggacttggtgctcaaatttctcctattggaattgcttctcagctcccaacaactaaccctgatgcaccagttatgttggaccgaatgttgcctctcttggcttgtttcaatatcctcacttgttcagttcgtactcaacaagatggaaagattcagagtctttattgtttggctactgttgctaa

SEQ ID NO: 16088 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcacatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16089 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcacatgattttaaaatcagctcttgaacttgatctcttagaaatctaaagttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16090 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcaaatgattttaaaatcagttattgaacttgatctcttagagctcgatctggtgctcaaatttcacctattgaaattgcttctcagctcccaacaactaaccctgatgcaccagttatgttggacctaatttttcgtctctttgcttgttacaatatcctcactttttcatttcttactcaacaagattcaaagattcacatactttatgatttttctactgttgctaa

SEQ ID NO: 16091 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttaccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16092 - DNA, 310 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttctccccatgattttgaaatcagctcttgaacttgatctcttagaaattaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16093 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttctccccatgattttaaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttaagttcgtactcaacaagatggaaagattcagagactttatggtttggctactgttgcta

SEQ ID NO: 16094 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttctccccatgattttaaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16095 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttctccccatgattttaaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16096 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttctccccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16097 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttctccccatgattttaaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16098 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttctccccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16099 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttctccccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagttggaaaggttcagagactttatggtttggctactgttgctaa

SEQ ID NO: 16100 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttctccccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16101 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttctcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16102 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttctacccatgattttaaaatcagctcttgaacttgatctcttagaaaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16103 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcctcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16104 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcctcccatgattttaaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16105 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcctcccatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16106 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcctcccatgattttaaaatcagctcttgaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctacttttgctaa

SEQ ID NO: 16107 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcatcccatgattttaaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16108 - DNA, 234 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttatgttggaccgaatgttgcgtctcttggcttgttataatatcctcacttgttcagttcgtactcaacaagatggaaaggttcagagactttatggtttggctactgttgctaa

SEQ ID NO: 16109 - DNA, 234 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttatgttggaccgaatgttgcgtctcttggcttgttacaatatcctcacttgttcagttcgtactcaacaagatggaaaggttcagagactttatggtttggctactgttgctaa

SEQ ID NO: 16110 - DNA, 234 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttatgttggaccgaatgttgcgtctcttggcttgttacaatatcctcacttgttcagttcgtactcaacaagatggaaagattcggagactttatggtttggctactgttgctaa

SEQ ID NO: 16111 - DNA, 234 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttatgttggaccgaatgttgcgtctcttggcttgttacaatatcctcacttgttcagttcgtactcaacaagatggaaagattcagagactttatggtttggctactgttgctaa

SEQ ID NO: 16112 - DNA, 233 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttatgttggaccgaatgttgcgtctcttggcttgttacaatatcctcacttgttcagttcgtactcaacaagatggaaaagttcagagactttatggtttggctatgttgctaa

SEQ ID NO: 16113 - DNA, 234 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttatgttggaccgaatgttgcgtctcttggcttgttacaatatcctcacttgttcagttcgtactcaacaagatggaaaagttcagagactttatggtttggctactgttgctaa

SEQ ID NO: 16114 - DNA, 234 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttatgttggaccgaatgttgcgtctcttggcttgttacaatatcctcacttgctcagttcgtactcaacaagatggaaagattcagagactttatggtttggctactgttgctaa

SEQ ID NO: 16115 - DNA, 234 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttatgttggaccgaatgttacgtctcttggcttgttacaatatcctcacttgttcagttcgtactcaacaagatggaaaggttcagagactttatggtttggctactgttgctaa

SEQ ID NO: 16116 - DNA, 234 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttatgttggaccgaatgttacgtctcttggcttgttacaatatcctcacttgttcagttcgtactcaacaagatggaaagattcagagactttatggtttggctactgttgctaa

SEQ ID NO: 16117 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16118 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagtgcttcccatgattttgaaatcagctcttgaacttgatctcttaaagctggacctgatgctcaaatttcacctgttcaaattgcttcacagcttccaacaactaaccctgatgcacccgtcatgttggaccgaatgttgcgtctcttggcttgttacaatatcctctcttgttcagttcgtactcaacaagatggaaaagttcagagactttatggtttggctactgttgctaa

SEQ ID NO: 16119 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagtccttcccatgattttgaaatcagctcttgaacttgatctctttaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16120 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagtccttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16121 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagtccttcccatgattttaaaatcagctcttgaacttgatctcttagaaattaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16122 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagtccttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16123 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagtacttcccatgattttaaaatcagctcttgagcttgatctcttggtgctcaaatttcacctattgaaattgcttctcagctcccaacaactaaccctgatgcaccagttaggttggaccgaatgtatcgtctcttggcttgttacaatatcctcacttgttcagttcgtactcaacaagatggaaagattcagagactttatggtttggctactgttgctaa

SEQ ID NO: 16124 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcaggtcttcccatgattttaaaatcagctcttgaacttgatctcttagctggacctggtgctcaaatttcacctattgaaattgcttctcagctcccaacaactaaccctgatgcaccagttatgttggacccaatgttgcgtctcttggcttgttacaatatcctcccttgttcagttcgtactcaacaagatggaaaggttcagagactttatggtttggctactgttgctaa

SEQ ID NO: 16125 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcaggtcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16126 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagctcttcccatgattttaaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16127 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagctcttcccatgattttaaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16128 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagatcttcctatgattttaaaatcagctcttgaacttgatctcttagaaatcatagctgaacctggtgttcaaatttcacctattgaaattgcttcacagcttccaacaactaaccctgaagcaccagttatgtttgaccgaatgttgcgtctctgggcttataacaatatcctcgcatgttcagatcgtactcaacaagatgcaaagattcagagacgttattgtttggctactatagctaa

SEQ ID NO: 16129 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagatcttcccatgattttgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16130 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagatcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtcacttggcttgttgcaatatcctcacttgttcagttcgtactcaacaagatggaaaggttcagagactttatggtttggctactgttgctaa

SEQ ID NO: 16131 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagatcttcccatgattttaaaatcagctcttgaacttgatctcttaagctggacctggtgctcaaatttcacctattgaaattgcttctcagctcccaacaactaaccctgatgcaccagttatgttggaccgaatgtttcgtctcttggcttgttacaatatcctcacttgttcagttcgtactcaacaagatggaaagattcagagactttatggtttggctactgttgctaa

SEQ ID NO: 16132 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcacttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16133 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcaattcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaatgattcagagactttatggtttggctactgttgctaa

SEQ ID NO: 16134 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcaattcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16135 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcaattcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16136 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcaattcttcccatgattttaaaatcagctcttgaacttgatctcttagaaatcaaagctggacctggtgctcaaatttcacctattgaaattgcttctcagcccccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16137 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcaattcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16138 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcaattcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16139 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttagttcttcccatgattttaaaatcagctcttgaacttgatctcttagaaatcaaagctggacctggtgctcaaatttcacctattgaaattgcttctaagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16140 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttaagttcttcccatgattttaaaatcagctcttgaacttgatctcttagaaatctaaagctggacctggttctcaaatttcacctattgaaattgcttctcagctcccaacaactaaccctgatgcaccagttaggttggaccgaatggtgcggcgcggggcgggggacaagggccgcacgggggaagggcggacgcaacaagagggaaagatgcagagacgtgaggggttggctactgttgctaa

SEQ ID NO: 16141 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttaagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16142 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttaagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16143 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttaagttcttcccatgattttaaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16144 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttaagttcttccaatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16145 - DNA, 234 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttaagttatgttggaccgaatgttgcgtctcttggctggttacaatatcctcactggttcagttcggactcaacaagatggaaagattcagagacgttatgggttggctactgttgctaa

SEQ ID NO: 16146 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgctccagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16147 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgctccagttcttcccatgattttaaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16148 - DNA, 234 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgctccagttatgttggaccgaatgttgcgtctcttggcttgttacaatatcctcacttgttcagttcgtactcaacaagatggaaaggttcagagactttatggtttggctactgttgctaa

SEQ ID NO: 16149 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgctagagttcttcccatgattttgaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16150 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgctacagttcttcccatgattttaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16151 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgctacagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16152 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcgtcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16153 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcgtcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16154 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcgtcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16155 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcgtcagttcttcccatgattttaaaatcagctcttgaacttgatctcttagaaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16156 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcctcagttcttcccatgattttaaaatcagctcttgaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 16157 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcctcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16158 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcctcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcactgttgcta

SEQ ID NO: 16159 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcctcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16160 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcctcagttcttcccatgattttaaaatcagctcttgaacttgatctcttagaaatcatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16161 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcctcagttcttcccatgattttaaaatcagctcttgaacttgatctcttagaaagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16162 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcctcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16163 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcatcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16164 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcatcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16165 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcatcagttcttcccatgattttaaaatcagctcttgaacttgatctcttagaaatcaagctggacctggtgctcaaatttcacctattgaaattgcttctcagcttccaacaactaaccctgatgcaccagtcatgttggaccgaatgttgcgtctcttggcttgttacaatatcctcacttgttcagttagtactcaacaagatggaaaagttcagacactttatggtttggctactgttgctaa

SEQ ID NO: 16166 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgattcatttcttcccatgattttaaaatcagctcttgaacttgatctcttagaaatcattaaagctggacctggtgctcaaatttcacctattgaaattgcttctcagctaccaacaactaaccctgatgcaccagttattttggaccgaatgttgcgtctctttgcttgttacaatatcctcacttgttcagttcgtactcaacaagatggaaagattcagacactttatggtttggctactgttgctaa

SEQ ID NO: 16167 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgattcagttcttcccatgattttaaaatcagctcttgaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 16168 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgattcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16169 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgattcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16170 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgattcagttcttcccatgattttaaaatcagctcttgaacttgatctcttagaaataaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagattgaaaagttcagagactttatggtttggctactgttgctaa

SEQ ID NO: 16171 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgattcagttcttcccatgattttaaaatcagctcttgaacttgatctcttagaaaaagctggacctggtgctcaaatttcacctattgaaattgattctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16172 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtccttcagttcttcccatgattttaaaatcagctcttgaacttgatctcttactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16173 - DNA, 260 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtccttcagttcttcccataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16174 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttgaaatcagctcttgaacttgatctcttagaactggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16175 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16176 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16177 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16178 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16179 - DNA, 406 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttgaaatcagctcttgaaattgatctcttagaaatcattgcccacggctttaccccggagcaggtggtggccatcgccagctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 16180 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttataatcagctcttgaacttgatctcttagaaatcgctggacctggtgttcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16181 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16182 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16183 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16184 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcactggttcagtgcgtactcaacaagatggaaagattcagagcctttatggtttggctactgttgctaa

SEQ ID NO: 16185 - DNA, 397 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatctggcggtggccaccacctgctggggggtcaagccgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16186 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16187 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16188 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcgctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16189 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16190 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16191 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaagggttcagagcctttatggtttggctactgttgctaa

SEQ ID NO: 16192 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16193 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 16194 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgactcttggcttgttacaatatcctcacttgttcagttcgtactcaacaatatggaaagattcagagactttatgatttggctactgttgctaa

SEQ ID NO: 16195 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16196 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16197 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16198 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagcgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16199 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagcgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16200 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagcgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16201 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagcgcttcagttcttcccatgattttaaaatcagctcttgaacttgatctcttagaaatcattggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16202 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagcgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16203 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagcgcttcagttcttcccatgattttaaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16204 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagagcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16205 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagagcttcagttcttcccatgattttgaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggctagttacaatatcctcacttgttcagttcgtactcaacaagatggaaagattcagagactttatggtttggctactgttgctaa

SEQ ID NO: 16206 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagagcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16207 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagagcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgtttcgtctcttggcttgttacaatatcctcacttgttcagttcgtactcaacaagatggaaaggttcagagactttatggtttggctactgttgcgaa

SEQ ID NO: 16208 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagagcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatttcctcacttgttgtgttcgtactcaacaagattgaaaggttcagagtctttattgtttggctactgttgctaa

SEQ ID NO: 16209 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagagcttcagttcttcccatgattttaaaatcagctcttgaacttgatatcttagaaatcaagctagaactgctgctcaaatttcacctattgaaattgcttctcagctcccaacaactaaccctgatgcaccagttatgttgaaccgaatgttgcgtctcttggcttgctacaatatcctcacttgttcagttcgtactcaacaagatggaaagattcagagactttatggtttggctactgttgctaa

SEQ ID NO: 16210 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaactgcttcagttcttcccatgattttaaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16211 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaaatgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16212 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaaatgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16213 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagaagtgcttcagttcttcccatgattttaaaatcagctcttgaacttgatctcttagaaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16214 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagaaagtgcttcagttcttcccatgattttaaaatcagctcttgaacttgatctcttagaaataagctggacctggtgctcaaatttcgcctattgaaattgcttctcagctaccaacaactaaccctgatgcaccagttatgttgaaccgaatgttgcgtctcttggcttgttacaatatccacacttgttcagttcgtactcaacaagaaggaaaacttcagagactttatggtttggctactgttgctaa

SEQ ID NO: 16215 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagaaagtgcttcagttcttcccatgattttaaaatcagctcttgaacttgatctcttagaaataaagctggacctggtgctcaaatttcacctattgaaattgcttctcagctcccaacaactaaccctgatgcaccagttatgtttgaccgaatgttgcgtctcttggcgtgttacaatatcctcacttgttcagttcgtactcaacaagatggaaaggttcagagactttatggtttggctactgttgctaa

SEQ ID NO: 16216 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattaccaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgtttctaa

SEQ ID NO: 16217 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattaccaagtgcttcagttcttcccatgattttaaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16218 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattaccaagggcttcagttctttccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16219 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16220 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16221 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaatcatgacttgttatgactgtttttttggggtacagtctatgcctcgggcatccaagcagcaagcgcgttacgccgtggttcgatgtttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16222 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16223 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16224 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaagctggacctggtgctcaaatttcacctattgaaattgcttctcagctcccaacaactaaccctgatgcaccagttattttggaccgaatgttgcgtctcttggcttgttacaatatcctcacttgttgagttcgtactcaacaagatggaaaggttcagagactttatggtttggctactgatgctaa

SEQ ID NO: 16225 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaacataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16226 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcctggcttgttacaatatcctcacttgttcagttcgtactcaacaagatggaaagattcagagactttatggtttggctactgttgctaa

SEQ ID NO: 16227 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16228 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaatcagcgagtgcttcagttcttcccatgattttaaaatcagctcttgaacttgatctcttagaaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16229 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaatcagcaagtgcttcagttcttcccatgattttgaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16230 - DNA, 462 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaatcagcaagtgcttcagttcttcccatgattttgaaatcagctcttgaacttgatctcttagaaatcactccgggccgttgcttcacaacgttcaaatccgctcccggcggatttgtcctactcaggagagcgttcaccgacaaacaacagataaaacgaaaggcccagtcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16231 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaatcagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16232 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaatcagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16233 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaataagcaagtgcttcagttcttcccatgattttaaaatcagctcttgaacttgatctcttagaaatagctggacttggtgctcaaatttcacctattgaaattgcttctcagctcccaacaactaaccctgatgcaccagttatgttggacctaatgttgcgtctcttggcttgttacagtatcctcacttgttcagttcgtactcaacaagatggaaagattcagagactttatggtttggctactgttgctaa

SEQ ID NO: 16234 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaacttgcaagtgcttcagttcttcccatgattttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16235 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactggcaagtgcttcagttcttcccatgattttgaaatcagttcttgaacttgatctcttagaaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16236 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactggcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcgtgttacaatatcctcacttgttcagttcgtactcaacaagatggaaagattcagagactttatggtttggctactgttgctaa

SEQ ID NO: 16237 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactatcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16238 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactatcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16239 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactatcaagtgcttcagttcttcccatgattttaaaatcagctcttgaacttgatctcttagaaatgctaaagctgtacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 16240 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagtaagtgcttcagttcttcccatgattttgaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16241 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagtaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16242 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagtaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16243 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagtaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16244 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagtaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16245 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagtaagtgcttcagttcttcccatgattttgaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16246 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagtaagtgcttcagttcttcccatgattttaaaatcagctcttgaacttgatctcttagaataaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16247 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactaggaagtgcttcagttcttcccatgattttgaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16248 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagctagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16249 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagctagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16250 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcgagtgcttcagttcttcccatgattttgaaatcagctcttgaacttgatctcttagatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16251 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcgagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16252 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcgagtgcttcagttcttcccatgattttgaaatcagctcttgaacttgatctcttagaaatcattgtaaagctggacctggtgctcaaatttctcctattgtaattgcttctcagctcccaacaactaaccctgatgcaccagttatgttggaccgaatgttgcgtctcgtggcttgttacaatatcctcacttgttcagttcgtactcaacaagatggaaagattcagagactttatggtttggctactgttgctaa

SEQ ID NO: 16253 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcgagtgcttcagttcttcccatgattttgaaatcagctcttgaacttgatctcttagaaatcattgtaaagctggacctggtgctcaaatttcgcctattgaaattgcttctcagctcccaacaactaaccctgatgcaccagttatgttggaccgagtgttgcgtctcttggattgttacaaaatcctcacttgttcagtgcgtactcaacaagatggaaagattcagagactttatggttgggctactgatgctaa

SEQ ID NO: 16254 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcgagtgcttcagttcttcccatgattttgaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16255 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcgagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16256 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcgagtgcttcagttcttcccatgattttgaaatcagctcttgaacttgatctcttaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16257 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcgagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16258 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcatgtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16259 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcatgtgcttcagttcttcccatgattttgaaatcagctcttgaacttgatctcttagaaattgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16260 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcatgtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16261 - DNA, 295 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcatgtgcttcagttcttcccatgattttaaaatcagctcttgaacctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16262 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcagtgcttcagttcctcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16263 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaggtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16264 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaggtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16265 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcacgtgcttcagttcttcccatgattttgaaatcatctcttgaacttgatctcttagctggacctggtgctcaaatttcacctattgaaattgcttctcagctaccaacaactaaccctgatgcaccagttatgttggaccgaatattgcgtctcttggcttgttacaatatcctcacttgttcagatcgtactcaacaatagggaaaggttcagagactttatggtttggctactgtttctaa

SEQ ID NO: 16266 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaattgcttcagttcttcccatgattttgaaatcagctcttgaacttgctctcttagaaatttaaagctggacctggtgctcaaatttcacctattgaaattgcttctcagctaccaacaactaaccctgatgcaccagttatgttggaccgaatgttgcgtctcttggattgttacaatatcctcacttgttcagttcgtactcaacaagatggaaaggttcagagactttatggtttggctactgttgctaa

SEQ ID NO: 16267 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaattgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 16268 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagttcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcatactcaacaagatggaaaagttcagagactttatggtttggctactgttgctaa

SEQ ID NO: 16269 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagttcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16270 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagttcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16271 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgtttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16272 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgtttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16273 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgtttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16274 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgtttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16275 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgtttcagttcttcccatgattttaaaatcagctcttgaacttgatctcttagaaatcattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16276 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtggttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16277 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgctttagttcttcccatgattttgaaatcagctcttgaacttgatctcttagaaatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16278 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgctttagttcttcccatgattttgaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16279 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgctttagttcttcccatgattttgaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16280 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgctttagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16281 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttgagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16282 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttctgttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16283 - DNA, 323 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttctgttcttcccatgataaagctggacctggtgctcaaatttcacctattgaaattgcttctcagctcccaacaactaaccctgatgcaccagttatgttggaccgaatgttgcgtctcttggcttgttacaatatcctcacgtgttcagttcgtactcaacaagatggaaaggttcagagactttatggtttggctactgttgctaa

SEQ ID NO: 16284 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttccgttcttcccatgattttgaaatcagctcttgaacttgatctcttagaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagaatttatggtttggctactgttgctaa

SEQ ID NO: 16285 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcatttcttcccatgattttgaaatcagctcttgaacttgattaaagctgtacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16286 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcatttcttcccatgattttgaaatcagctcttgaacttgatctcttagaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16287 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcatttcttcccatgattttgaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16288 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcatttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16289 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcatttcttcccatgattttgaaatcagcccttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16290 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagtttttcccatgattttgaaatcagctcttgaacttgatctcttagaaatctaaagctggacctggtgctcaaatttctcctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 16291 - DNA, 317 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttttaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16292 - DNA, 317 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16293 - DNA, 317 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16294 - DNA, 317 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttttaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16295 - DNA, 317 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16296 - DNA, 317 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16297 - DNA, 317 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttgagagactttatggtttggctactgttgctaa

SEQ ID NO: 16298 - DNA, 317 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttttaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggttactgttgctaa

SEQ ID NO: 16299 - DNA, 317 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttttaaagctggacctggtgctcaaatttcacctattgaaattgcttctcagctaccaacaactaaccctgatgcaccagttatgttggaccgaatgttgcgtctcttggcttgttacaatatcctcacttgttcatttcgtactcaacaagatggaaaggttcagagactttatggtttggctactgttgctaa

SEQ ID NO: 16300 - DNA, 311 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaccaagatggaaagattcagagactttatggtttggctactaa

SEQ ID NO: 16301 - DNA, 317 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttttaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16302 - DNA, 317 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttttaaagctggacctggtgctcaaatttcacctattgaaactgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16303 - DNA, 317 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttttaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16304 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttctttccatgattttgaaatcagctcttgaacttgatctcttagaaatcaagctggacctggtgctcaaatttcacctattgaaattgcttctcagctaccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 16305 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttctttccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16306 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttgcaatgattttgaaatcagctcttgaactcgatctcttagactggacctggtgctcaaatttcacctattgaaattgcttctcagctcccaacaactaaccctgatgcaccagttatgttggaccgaatgttgcgtctcttggcttgttacaatatcctcacttgttcatttcgtactcaacaagatagaaaggttcagaaactttatggtttgggtttgttgctaa

SEQ ID NO: 16307 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttctcatgattttgaaatcagctcttgaacttgatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16308 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttctcatgattttgaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16309 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttctcatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16310 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttctcatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16311 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttctcatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16312 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttctcatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16313 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcctatgattttgaaatcagctcttgaacttgatttcttagaaaagctggacctggtgctcaaatttcacctatttaaattgcttctcagctaccaacaactaaccctgatgcaccagttatgttggaccgaatttggcgtctcttgtcttgttacaatatcctcacttgttcagttcgtactcaacaatgtggaaagattcagagactttatggtttggcgactattgctaa

SEQ ID NO: 16314 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcctatgattttgaaatcagctcttgaacttgatctcttagaaatctaaagctggacctggtactcaaatttcacctattgaaattgcttctcagctaccaacaactaaccctgatgcaccagttatgttggaccgaatgttgcgtcacttggcttgttacaatatcctcacttgttcagttcgtactcaacaagatggaaaggttcagagactttatggtttggccactgttgctaa

SEQ ID NO: 16315 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcctatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16316 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcctatgattttgaaatcagctcttgaacttgatctcttaaagctggacctggtgctcaaatttcacctattggaattgcttctcagctaccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 16317 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcctatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16318 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcctatgattttaaaatcagctcttgaacttgatctcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16319 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccttgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16320 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccgtgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16321 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccgtgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16322 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccgtgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctctgttgctaa

SEQ ID NO: 16323 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccattattttgaaatcagctcttgaacttgatctcttagttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16324 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccattattttgaaatcagctcttgaacttgatctcttagaatgctcaaatttcacctattgaaattgcttctcagctaccaacaactaaccctgatgcaccagttatgttggaccgaatgttgcgtctcttggcttgttacaatatccttacttgttatgttcgtactcaacaagacggaaaggttcagagactgtatggtttggctactggtgctaa

SEQ ID NO: 16325 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccattattttgaaatcagctcttgaacttgatctcttagaaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16326 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccattattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16327 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgtttttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16328 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatggttttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16329 - DNA, 319 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatggttttgaaatcagctcttgaacttgatctcttagaaatcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16330 - DNA, 406 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgcttttaaaatcagctcttgaacttgatctcttagaaatcattgcccacggcttgaccccggagcaggtggtggccatcgccagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16331 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttttaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16332 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgtaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctctcttgttcagttcgtactcaacaagatggaaaggttcagagactttatggttttgcgactgttgctaa

SEQ ID NO: 16333 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgtaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16334 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttggaatcagctcttgaacttgatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16335 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttggaatcagctcttgaacttgatctcttagaatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16336 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttggaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16337 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttggaatcagctcttgaacttgatctcttagaaatcactggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16338 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgcaatcagctcttgaacttgatctcttagaactttaaagctggacctggagctcaaatttcacctattgaaattgcttctcagctaccaacaactaaccctgatgcaccagttatgttggaccgaatgttgcctctcttggctggttacaatatcctcacttgttcagttcgtactcaacaagaaggaaagtttcagagacttgatagtttggctactggtgctaa

SEQ ID NO: 16339 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgagatcagctcttgaacttgatctcttagaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16340 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgagatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16341 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgagatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16342 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgagatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16343 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgagatcagctcttgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16344 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgacatcagctcttgaacttgatctcttagaaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16345 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgacatcagctcttgaacttgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16346 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16347 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16348 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaattgcttctcagctaccgacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16349 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16350 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16351 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16352 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaattgcttctcagctaccaacaactaaccctgatgcaccagttatgttggaccgaatgttgcgtctcttggcttgttacaatatcctcacttgttcagttcgtactcaacaagatggaaaagttcagagactttattgtttggctactgttgctaa

SEQ ID NO: 16353 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaattgcttctcagctaccaacaactaaccctgatgcaccagttatgttggaccgaatgttacgtctcttggcttgttacaatatcctcacttgttcagttcgtactcaacaagatggaaaggttcagagactttatggtttggctactgttgctaa

SEQ ID NO: 16354 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaattgcttctcagctaccaacaactaaccctgatgcaccagttatgttggaccgaatgttacgtctcttggcttgttacaatatcctcacttgttcagttcgtactcaacaagatggaaagattcagagactttatggtttggctactgttgctaa

SEQ ID NO: 16355 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaattgcttctcagctaccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 16356 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaattagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgtgcagttcgtactcaacaagatggaaaggttcagagactttatggtttggctactgtggctaa

SEQ ID NO: 16357 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatctgctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16358 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16359 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16360 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatctaaagctggacctggtgctcaaatttcacctattgaaattgcttctcagctaccaacaactaaccctgatgcaccagttatgttggaccgaattttgcgtctcttggcttgttacaatatcctcacttgttcagttcgtactcaacaagatggaaaagttcagagactttatggtttggctactgttgctaa

SEQ ID NO: 16361 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16362 - DNA, 332 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctacgttgctaa

SEQ ID NO: 16363 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16364 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcggctcttgaacttgatctcttagaactggacctggtgctcaaatttcacctattgaaattgcttctcagctaccaacaactaaccctgatgcaccagttatgtttgaccgaatgttgcgtctcttggcttgttacaatatcctcacttgttcagttcgtactcaacaagatggaaaggttcagagactttatgggttggctactgttgctaa

SEQ ID NO: 16365 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcggctcttgaacttgatctcttagaaattaaagctggacctggtgctcaaatttcacctattgaaattgcttctcagctacccacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16366 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcggctcttgaacttgatctcttagaaaactaaagctggacctggtgctcaaatttcacctattgaaattgcttctcagctaccaacaactaaccctgatgcaccagttatgttggaccggatgttgcgtctcttggcttgttacaatatcctcacttgttcagttcgtactcaacaagatggaaaagttcagagactttatggtttggctactgttgctaa

SEQ ID NO: 16367 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagttcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16368 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagttcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16369 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagttcttgaacttgatctcttagaaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16370 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagttcttgaacttgatctcttagaaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16371 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagttcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16372 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagttcttgaacctgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16373 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctgttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16374 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgtacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16375 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttggacttgatctcttagactacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16376 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttggacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16377 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgatcttgatctcttagaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16378 - DNA, 366 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgatcttgatctcttagaaatcatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16379 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgagcttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16380 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgagcttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16381 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16382 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16383 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgagctaaagctggacctggtgctcaaatttcacctattgaaattgcttctcagctaccaacaactaaccctgatgcaccagttatgttggaccgaatgttgcgtctcttggattgttacaatatcctcacttgttcagttcgtactcaacaagatggaaaggttcagagactttatggtttggctactgttgctaa

SEQ ID NO: 16384 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16385 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16386 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16387 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgagctaaagctggacctggtgctcaaatttcacctattgaaattgcttctcagctaccaacaactaaccctgatgcaccagttatgttggaccgaatgttgcgtctcttggcttgttacaatatcctctcttgttcagttcgtactcaacaagatggaaaggttcagagactttatggtttggctactgttgctaa

SEQ ID NO: 16388 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgagctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16389 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaatttcacctgttcaaattgcttctcagcttccaacaactaaccctgatgcaccagtcatgttggaccgaatgttgcgtctcttggcttgttacaatatcctcacttgttctgttcgtactcagcaagatggaaaggttcagagactttatggtttggctactgttgctaa

SEQ ID NO: 16390 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16391 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16392 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16393 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16394 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16395 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16396 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16397 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 16398 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaagttgatctcttagaaatcatcaagctggacctagtgctcaaatttcacctattgaaattgcttctcatctcccaacaactaaccctgatacaccagttatgttggatcgaatattgagtctcttggcttgttgcaatatcctcacttgtgcagtacgtaataaacaagatggaatgattcagagactgtatggtttggctactgttgctaa

SEQ ID NO: 16399 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16400 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16401 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16402 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16403 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 16404 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16405 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16406 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 16407 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaagctggacctggtgctcaaatttcacctattgaaattgcttctcagctaccaacaactaaccctgatgcaccagttatgttggaccgaatgttgcgtctcttgacttgttacaatatcctcacttgttctgttcgtactcaacaagatggaaaggttcagagactttatggtttggctactgttgctaa

SEQ ID NO: 16408 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaagctggacctggtgctcaaatttcacccattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16409 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaagctggacctgatgctcaaatttcacctattgaaattgcttctcagctaccaacaactaaccctgatgcaccagttatgttggaccgaatgttgcgtctctaggcttgttacaatatcctcacttgttcagttcgtactcaacaagatggacagtttcagagactttatggtttggctactggtgctaa

SEQ ID NO: 16410 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16411 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16412 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16413 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactttatctcttagaaatcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16414 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactttatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16415 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16416 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16417 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgttctcttagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16418 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgttctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16419 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgttctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16420 - DNA, 332 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 16421 - DNA, 332 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16422 - DNA, 332 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16423 - DNA, 332 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgtgctcaaatttcacctattgaaattgcttctcagctaccgacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16424 - DNA, 332 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16425 - DNA, 332 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16426 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgtgctcaaatttcacctattgaaattgcttctcagctaccaacaactaaccctgatgcaccagttatgttggaccgaatgttgcgtctcttggcttgttacaatatcctcacttgtgcagttcgtactcaacaagatggaaaggttcagagactttatggtttggctactgtgctaa

SEQ ID NO: 16427 - DNA, 332 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16428 - DNA, 332 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16429 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttggtctcttagaaattaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16430 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttggtctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16431 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttggtctcttagaaatcatggacctggtgctcaaatttcacctattgaaattgcttctcagctaccaacaactaacccttatgcaccagttatgttggaccgaatgttgcgtctcttggcttgttacaatatcctcacttgttcagttcgtactcaacaagatggaaagattcagagactttatggtttggctactgttgctaa

SEQ ID NO: 16432 - DNA, 395 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttggtctcttagaaatcagcgccggcctgccgccgccattgctggcgatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16433 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttggtctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16434 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatttcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16435 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatttcttaaagctggacctggtgctcaaatttcacctattgaaattgcttctcagctcccaacaactaaccctgatgcaccagttatgttggaccgaatgttgcgtctcttggcttgttataatatcctcacttgttctgttcgtactcaacaagatggaaaggttcagagactttatggtttggctactgttgctaa

SEQ ID NO: 16436 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatttcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16437 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatttcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatagaaaggttcagagactttatggtttggctactgttgctaa

SEQ ID NO: 16438 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatttcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16439 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatttcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16440 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatttcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 16441 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatttcttaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 16442 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgattaaagctggacctggtgttcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16443 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 16444 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgattaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16445 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16446 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgattaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16447 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16448 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16449 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 16450 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16451 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16452 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 16453 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatggacctgttgctcagatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 16454 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16455 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16456 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16457 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16458 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16459 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatggacctggtgctcaaatttcacctattgaaattgcttctcagctaccaacaactaaccctgatgcaccagttatgttggaccgaatgttgcgtctcttggcttgttacaatatcctcacttgttcagttcgtactcaactagatggaaaagttcagagactttatggtttggctactgttgctaa

SEQ ID NO: 16460 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16461 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16462 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16463 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagattgaaaagttcagagactttatggtttggctactgttgctaa

SEQ ID NO: 16464 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16465 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16466 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16467 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16468 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16469 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16470 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 16471 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16472 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16473 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttgctaaagctggacctggtgctcaaatttcacctattgaaattgcttctcagctaccaacaactaaccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 16474 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16475 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16476 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16477 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16478 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16479 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16480 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttaaagctggacctggtgctcaaatttcacctattgaaattgcttctcagctcccaacaactaaccctgatgcaccagttatgttggaccgaatgttgcgtctcttggcttgttacaatatcctcgcttgttcagttcgtactcaacaagatggaaagattcagagactttatggtttggctactgttgctaa

SEQ ID NO: 16481 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 16482 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16483 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16484 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16485 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 16486 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16487 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16488 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16489 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggacctggtgctcaaatttcacctattgaaattgcttctcagctaccaacaactaaccctgatgcaccagttatgttggaccgaatgttgcgtctcttggcgtgttacaatatcctcacttgttcagttcgtactcaacaagatggaaagattcagagactttatggtttggctactgttgctaa

SEQ ID NO: 16490 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctttggacctggtgctcaaattccacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16491 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctttgaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16492 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctttaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16493 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctttaaagctggacctggtgctcaaatttcacctattgaaattgcttctcagctcccaacaactaaccctgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 16494 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16495 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16496 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttaaggtttggctactgttgctaa

SEQ ID NO: 16497 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16498 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16499 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16500 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggaataaagctggacctggtgctcaaatttcacctattgaaattgcttctcagctcctaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16501 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16502 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16503 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16504 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16505 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttgctggggggtcaagccgtgggcctggcacagcaccggcaacagccgctggaccgtctccagcgcctgcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16506 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttgctggggggtcaagccgtgggcctggcacagcaccggcaacagccgctggaccgtctccagcgcctgcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16507 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16508 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16509 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16510 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16511 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttctaaagctggacctggtgctcaaatttcacctgttcaaattgcttctcagcttccaacaactaaccctgatgcaccagtcatgttggatcgaatgttgcgtctcttggcttgttacaatatcctcacttgttcagttcgtactcaacaagatggaaaggttcagagactttatggtttggctactgttgctaa

SEQ ID NO: 16512 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16513 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttctaaagctggacctggtgctcaaatttcacctattgaaattgcttctcagctcccaacaactaaccctgatgcaccagttatgttgtaccgaatgttgcgtctcttggcttgttacaatatcctcacttgttcagttcgtactcaacaagatggaaaagttcagagactttatggtttggctactgttgctaa

SEQ ID NO: 16514 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16515 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16516 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16517 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16518 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16519 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttctaaagctggacctggtgctcaaatttcacctattgaaattgcttctcagctaccaacaactaaccctgatgcaccagttatgttggaccgaatattgcgtctcttggcttgttacaatatcctcacttgttcagttcgtactcaacaagatggaaaggttcagagactttatggtttggctactgttgctaa

SEQ ID NO: 16520 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16521 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16522 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttctaaagctggacctggtgctcaaatttcacctattgaaattgcttctcagctaccaacaactaaccctgatgcaccagttatgttggaccgaatgttgcgtctcttggcttgttacagtatcctcacttgttcagttcgtactcaacaagatggaaaggttcagagactttatggtttggctactgttgctaa

SEQ ID NO: 16523 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16524 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttacggtttggctactgttgctaa

SEQ ID NO: 16525 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttctaaagctggacctggtgctcaaatttcacctattgaaattgcttctcagctaccaacaactaaccctgatgcaccagtcatgttggaccgaatgttgcgtcccttggcttgttacaatatcctcacttgttctgttcgtactcaacaagatggaaaggttcagagactttatggtttggctactgttgctaa

SEQ ID NO: 16526 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttataaataaagctggacctggtgctcaaatttcacctattgaaattgcttctcagctaccaacaactaaccctgatgcaccagttatgttggaccgaatattgcgtctcttggcttgttacaatatcctcacttgttcagttcgtactcaacaagatggaaaggttcagagactttatggtttggctactgttgctaa

SEQ ID NO: 16527 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16528 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16529 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16530 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16531 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16532 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16533 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttataaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 16534 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttataaagctggacctggtgcgcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16535 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16536 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16537 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16538 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagttggacctggtgctcaaatttcacctattgaaattgcttctcagctaccaacaactaaccctgatgcaccagttatgttggaccgaatgttgcgtctcttggcttgttacaatatcctcaattgttaagttcgtactcaacaagatggaaaggttcagagactttatggtttggctactgttgctaa

SEQ ID NO: 16539 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtgctcaaatttcacctattgaaattgcttctcatctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16540 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16541 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16542 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16543 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16544 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtgctcaaatttcacctattgaaattgcttctcagctaccaacaactaaccctgatgcaccagttatgttggaccgaatgttgcgtctcttggcttgttacaataccctcacttgttcagttcgtactcaacaagatggaaaagttcagagactttatggtttggctactgttgctaa

SEQ ID NO: 16545 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtgctcaaatttcacctattgaaattgcttctcagctaccaacaactaaccctgatgcaccagttatgttggaccgaatgttgcgtctcttggcttgttacaatatcctcacttgtgcagttcgtactcaacaagatggaaaggttcagagactttatggtttggctactgttgctaa

SEQ ID NO: 16546 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16547 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtgatcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16548 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtgatcaaatttcacctattgaaattgcttctcagctaccaacaactaaccctgatgcaccagttatgttggaccgaatgttgcgtctcttggcttgttacaacatcctcacttgttcagttcgtactcaacaagatggaaaggttcagagactttatggtttggctactgttgctaa

SEQ ID NO: 16549 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16550 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16551 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16552 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtactaaagctggacctggtactcaaatttcacctatttaaattgcttctcagctaccaaaaactaaccctgatgcaccagttatgttggaccgaatgttgcgtctcttggcttgttacaatatcctcacttgttcagttcgtactcaacaagatggaaagattcagagactttatggtttggctactgtggctaa

SEQ ID NO: 16553 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaatcattggacctggtgcacaaatttcacctgatcaaattgcttctcagcttccaacaactaaccctgatgcaccagtcatcttggactgaatgttgcgtctcttggctagttacaatatcctcacttgttctgttcgtactcaacaagacggaaaggttcacagactttatggtttggctactgttgctaa

SEQ ID NO: 16554 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16555 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16556 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16557 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16558 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16559 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16560 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16561 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtaa

SEQ ID NO: 16562 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctcccaacaactaaccctgaggcaccagttatgttggaccgaatgttgcgtctcttggcttgttacaatatcctcacttgttcagtgcgtactcaacaagatggaaaggttcagagactttatggtttggctactgtgctaa

SEQ ID NO: 16563 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctaccaacagctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16564 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16565 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16566 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16567 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctaccaacaactaaccctgatgcaccagttatgttggaccgaatgttgcggctcttggcttgttacaatatcctcacttgttcagttcgtactcaacaagatggaaaggttcagagactttatggtttggctactgttgctaa

SEQ ID NO: 16568 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16569 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 16570 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16571 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaattccacctattgaaattgcttctcagctaccaacaactaaccctgatgcaccagttatgttggaccgaatgttgcgtctcttggcttgttacaatatcctcacttgtgcagttcgtactcaacaagatggaaaggttcagagactgtatggtttggctactgttgctaa

SEQ ID NO: 16572 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16573 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtcctcaaatttcacctattgaaattgcttctcagctaccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 16574 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16575 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctagtgctcaaatttcacctattgaaattgcttctcagctcccagcaactaaccctgattcaccagttatgttggaccgaatgttgcgtctcttggcttgttacaatagcctcacttgtgcagttcgtactcaacaagatggaaaggttcagagactttatggtttggctactgttgctaa

SEQ ID NO: 16576 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagccggacctggtgctcaaatttcacctattgaaattgcttctcagctaccaacaactgaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16577 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaggctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16578 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaggctggacctggtgctcaaatttcacctattgaaattgcttctcagctcccaacaactaaccctgatgcaccagttatgttggaccgaatgttgcgtctcttggcttgttacaatatcctcacttgttcagttcttactcaacaagatggaaaggttcagagactttatggtttggctactgttgctaa

SEQ ID NO: 16579 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaggctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16580 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaggctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16581 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaggctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16582 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaggctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16583 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaggctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 16584 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaggctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16585 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16586 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaggacctggtgctcaaatttcacctattgagattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16587 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16588 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16589 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16590 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaggaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16591 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctgtacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16592 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16593 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16594 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16595 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16596 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16597 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16598 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 16599 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16600 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctcccaacaactaaccctgatgcaccagttatgttggaccgaatgttgcgtctcttggtttgttacaatatcctcacttgttcagttcgtactcaacaagatggaaagattcagagactttatggtttggctactgttgctaa

SEQ ID NO: 16601 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16602 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 16603 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctcccaacaactaaccctgatgaaccagttatgttggaccgaatgttgcgtctcttggcttgttacaatatcctcacttgttcagttcgtactcaacaagatggaaaggttcagagactttatggtttggctactgttgctaa

SEQ ID NO: 16604 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaacccttatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16605 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16606 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctta

SEQ ID NO: 16607 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16608 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16609 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 16610 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16611 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtcacttggcttgttacaatatcctcacttgttcagttcgtactcaacaagatggaaaggttcagagactttatggtttggctactgttgctaa

SEQ ID NO: 16612 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 16613 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 16614 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctacgttgctaa

SEQ ID NO: 16615 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 16616 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctctttgcttgttacaatatcctctcttgttcagttcgtactcaacaagatggaaatattcagacacttgatggtttggcgaatgttcctaa

SEQ ID NO: 16617 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgtgctaa

SEQ ID NO: 16618 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgtggcgtcgcatggcttgttacaatatcctcacttgttcagtgcgtactcaacaagatggaaagattcagagacttgatggtttggctactgttgctaa

SEQ ID NO: 16619 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgatgcgtctcttggcttgttacaatatcctcacttgttcagttcgtactcaacaagatggaaagattcagagactttatggtttggctactgttgctaa

SEQ ID NO: 16620 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16621 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16622 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctgaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16623 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 16624 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16625 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16626 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16627 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctaccaacaactagccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16628 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctaccaacaactaaccctgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 16629 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16630 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16631 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16632 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctaccaacaactaaccctgatgcaccagttatgttggaccgaatgttgcgtctcttagcttgttacaatatcctcacttgttcagttcgtactcaacaagatggaaaagttcagagactttatggtttggctactgttgctaa

SEQ ID NO: 16633 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcctaa

SEQ ID NO: 16634 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16635 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 16636 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 16637 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctaccaacaactaaccctgatgcaccacttatgttggaccgaatgttgcgtctcttggcttgttacaatatcctcacttgttcagttcgtactcaacaagatggaaaggttcagagactttatggtttggctactgttgctaa

SEQ ID NO: 16638 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctacaaacaactaaccctgatgcaccagttatgttggaccgaatttggcgtctcttggcttgttacaatatcctctctttttcagtccgtactcaacaagatggaaaatttcagagcctttatggtttggctactgttgctaa

SEQ ID NO: 16639 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctatgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16640 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggaccaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16641 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16642 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16643 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16644 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16645 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16646 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16647 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagatggacctggtgctcaaatttcacctattgaaattgcttctcagctaccaacaactaaccctgatgcaccagttatgttggaccgaatgttgcgtctcgtggcttgttacaatatcctcacttgttcagttcgtactcaacaagatggaaaggttcagagactttatggtttggctactgttgctaa

SEQ ID NO: 16648 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16649 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttgtggtttggctactgttgctaa

SEQ ID NO: 16650 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagatggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16651 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16652 - DNA, 438 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagatgctgtgccaggcccacggcttgaccccccagcaggtggtggccatcgccagcaataatggtggcaagcaggcgctggagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16653 - DNA, 438 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagatgctgtgccaggcccacggcttgaccccccagcaggtggtggccatcgccagcaataatggtggcaagcaggcgctggagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16654 - DNA, 438 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagatgctgtgccaggcccacggcttgaccccccagcaggtggtggccatcgccagcaataatggtggcaagcaggcgctggagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16655 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagatcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16656 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagatcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16657 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagatcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16658 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagatcaaatttcacctattgaaattgctcctcagctcccaacaactaaccctgatgcaccagttatgttggaccgaatgttgcgtctcttggcttgttacaatatcctcacttgttcagttcgtactcaacaagatggaaagattcagagactttatggttttgctactgttgctaa

SEQ ID NO: 16659 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagatatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16660 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcatctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16661 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 16662 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16663 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16664 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16665 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggtactgttgctaa

SEQ ID NO: 16666 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtacttaacaagatggaaaggttcagagactttatggtttggctactgttgctaa

SEQ ID NO: 16667 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgtttcaatatcctcacttgttcagttcgtactcaacaagatggaaaggttcagagactttatggtttggctactgttgctaa

SEQ ID NO: 16668 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16669 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16670 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16671 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggcactgttgctaa

SEQ ID NO: 16672 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacgagatggaaaggttcagagactttatggtttggctactgttgctaa

SEQ ID NO: 16673 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactttgctaa

SEQ ID NO: 16674 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 16675 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctatgttgctaa

SEQ ID NO: 16676 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagtgctaaagctggacctggtgctcaaatttcacctattgaaattgcttctcagctcccaacaactaaccctgatgcaccagttattttttaccgaattttgcgtctcttggctttttacaatatcctcacttattcagttcgtactcaacaagatggaaacgttcagagactttatggtttcgctactgttgctaa

SEQ ID NO: 16677 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagtgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16678 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaggctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16679 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16680 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 16681 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 16682 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 16683 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16684 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaatttcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16685 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16686 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16687 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 16688 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctcccaacaactaaccctgatgcaccagttatgttggaccgaatgttgcgtcgcttggcttgttacaatatcctcacttgttcagttcgtactcaacaagatggaaaggttcagagactgtatggtttggctactgttgctaa

SEQ ID NO: 16689 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16690 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagatacagagactttatggtttggctactgttgctaa

SEQ ID NO: 16691 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16692 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctaccaacacctaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 16693 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16694 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16695 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16696 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctaccaacaactaaccctgatgcaccagttatgttggaccgaatgtttcgtctcttggcttgttacaatatcctcacttgttcatttcgtactcaacaagatggaaaatttcagagactttatggtttggctactgttgctaa

SEQ ID NO: 16697 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatagaaaggttcagagactttatggtttggctactgttgctaa

SEQ ID NO: 16698 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactttgctaa

SEQ ID NO: 16699 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctaccaacaactaaccctgatgcaccagttatgttggaccgaatgttgcgtctcttggcttgatacaatatcctcacttgttcagtttgtactcaacaagatggaaagattcagagactttatggtttggctactgttgctaa

SEQ ID NO: 16700 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16701 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctcgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16702 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16703 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaagaagatggaaagattcagagactttatggtttggctactgttgctaa

SEQ ID NO: 16704 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagatcaaagctggacctggtgctcaaatttcacctattgaaattgcttctcagctaccaacaactaaccctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 16705 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagacttgacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactggtgctaa

SEQ ID NO: 16706 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16707 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16708 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactggacctggtgctcaaatttcacctattgaaattgcttctcagctaccaacaactaaccctgatgcaccagttatgttggaccgaatgttacgtctcttggcttgttacaatatcctcacttgttcagttcgtactcaacaagatggaaaggttcagagactttatggtttggctactgttgctaa

SEQ ID NO: 16709 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16710 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16711 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16712 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactggacctggtgctcaaatttcacctattgaaattgcttctcagctaccaacaactaaccctgatgcaccagttatgttggaccgaatgttgcgtctcttggcttgttacaatatcctcacttgttcagttcgttctcaacaagatggaaaggttcagagactttatggtttggctactgttgctaa

SEQ ID NO: 16713 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 16714 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16715 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16716 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactacctggtgctcaaatttcacctattgaaattgcttctcagctaccaacaactaaccctggtgcaccagttatgttggaccgaatgttgcgtctcttggcttgttacaatatcctcacttgttcagttcgtactcaacaagatggaaaggttcagagcctttatggtttggctactgttgctaa

SEQ ID NO: 16717 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactacctggtgctcaaatttcacctattgaaattgcttctcagctaccaacaactaaccctgatgcaccagttatgttggaccgaatgttgcgtctcttggcttgttacaatatcctcacttgtttagttcgtactcaacaagatggaaaggttcagagactttatggtttggctactgttgctaa

SEQ ID NO: 16718 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16719 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16720 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16721 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggttggctactgttgctaa

SEQ ID NO: 16722 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctgttgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16723 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctggtgctcaaatttcgcctgttcaaattgcttctcagcttccaacaactaaccctgatgcaccagtcatgttggaccgaatgttgagtctcttggcttgatacaatatcctcgcttgatctgttcatactcaacaagatggaaaggttcagagacgttaaggtttggctactggtgctaa

SEQ ID NO: 16724 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 16725 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16726 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16727 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16728 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16729 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 16730 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16731 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16732 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16733 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctggtgctcaaatttcacctattgaaattgcttctcagctaccaacaactaaccctgatgcaccagttatgttggaccgaatgtttcgtctcttggcttgttacaatatcctcacttgttcagttcgtactcaacaagatggaaaagttcagagactttatggtttggctactgttgctaa

SEQ ID NO: 16734 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16735 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctat

SEQ ID NO: 16736 - DNA, 476 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagacggtccagcgcctgcttgccaccgccattgctggcgatggccaccacctgctggggggtcaagttgagcgggcctggcacagcaccggcaacagccgctggaccgtctccagcgcctgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16737 - DNA, 476 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagacggtccagcgcctgcttgccaccgccattgctggcgatggccaccacctgctggggggtcaagttgagcgggcctggcacagcaccggcaacagccgctggaccgtctccagcgcctgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16738 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16739 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16740 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagacctggtgctcaaatttcacctattgaaattgcttctcagctcccaacaactaaccctgatgcaccagttatgttggaccgaatgttgcgtctcttggcttgttacaatatcatcacttgttcagttcgtactcaacaagatggaaagattcagagactttatggtttggctactgttgctaa

SEQ ID NO: 16741 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16742 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16743 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16744 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 16745 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagacattaacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaagttcagagactttatggtttggctactgttgctaa

SEQ ID NO: 16746 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagacataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16747 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16748 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagacataaagctggacctggtgctcaaatttcacctattgaaattgcttctcagctaccaacaactaaccctaatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 16749 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16750 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatttcccggctggaaagcgggcagtgagcgcaacgcaattaatacgcgtaccgctagccagctaaagctggacctggtgctcaaatttcacctattgaaattgcttctcagctaccaacaactaaccctgatgcaccagttatgttggaccgaatgttgcgtctcttggcttgctacaatatcctcacttgttcagttcgtactcaacaagatggaaaggttcagagactttatggtttggctactgttgctaa

SEQ ID NO: 16751 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatttcccgactggaaagcgggcagtgagcgcaacgcaattaatacgcgtaccgctagccagctaaagctggacctggtgctcaaatttctcctattgaaattgcttctcagctcccaacaactaaccctgatgcaccagttatgttggaccgaatgttgcgtctcttggcttgtcacaatatcctcacttgttcagttcgtactcaacaagatggaaagattcagagactttatggtttggctactgttgctaa

SEQ ID NO: 16752 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatttcccgactggaaagcgggcagtgagcgcaacgcaattaatacgcgtaccgctagccagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16753 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatttcccgactggaaagcgggcagtgagcgcaacgcaattaatacgcgtaccgctagccagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16754 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatttcccgactggaaagcgggcagtgagcgcaacgcaattaatacgcgtaccgctagccagctaaagctggacctggtgctcaaatttcacctattgaaattgcttctcagctaccaacaactaaccctgatgcaccagttatgttggaccgagtgttgcgtctcttggcttgttacaatatcctcacttgttcagttcgtactcaacaagatggaaaggttcagagactttatggtttggctactgttgctaa

SEQ ID NO: 16755 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatttcccgactggaaagcgggcagtgagcgcaacgcaattaatacgcgtaccgctagccagctaaagctggacctggtgctcaaatttcacctattgaaattgcttctcagctaccaacaactaaccctgatgcaccagttatgttggaccgaatgttgcgtctcttggcttgctacaatatcctcacttgttcagttcgtactcaacaagatggaaaggttcagagactttatggtttggctactgttgctaa

SEQ ID NO: 16756 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatttcccgactggaaagcgggcagtgagcgcaacgcaattaatacgcgtaccgctagccagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16757 - DNA, 335 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16758 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatttaaagctggacctggtgctcaaatttcacctattgaaattgcttctcagctaccaacaactaaccctgattcaccagttatgttggaccgaatgttgcgtctcttggcttgttacaatatcctcacttgttcagttcgtactcaacaagatggaaaagttcagagcctttatggtttggctactgttgctaa

SEQ ID NO: 16759 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16760 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16761 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatttaaagctggacctggtgctcaaatttcacccattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16762 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16763 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 16764 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 16765 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctattgaaatttcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16766 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctattgaaattgcttctcatctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16767 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16768 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16769 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16770 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcacttgtccagttcgtactcaacaagatggaaaggttcagagactttatggtttggctactgttgctaa

SEQ ID NO: 16771 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctattgaaattgcttctcagctaccaacaactaaccctgatgcacgagttatgttggaccgaatgttgcgtctcttggcttgttacaatatcctcacttgttcagttcgtactcaacaagatggaaaggttcagagactttatggtttggctactgttgctaa

SEQ ID NO: 16772 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctattgaaattgcttctcagctaccaacaactaaccctgatgcaccagttatgttggaccgaatgttgcgtctcttggcttggtacaatatcctcacttgttcagttcgtactcaacaagatggaaaggttcagagactttatggtttggctactgttgctaa

SEQ ID NO: 16773 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16774 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 16775 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16776 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16777 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgcactcaacaagatggaaagattcagagactttatggtttggctactgttgctaa

SEQ ID NO: 16778 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 16779 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctattgaaattgcttctcagctaccaacaactaaccctgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 16780 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagatggaaaggttcagagactttatggtttgggtactgttgctaa

SEQ ID NO: 16781 - DNA, 398 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatgtccagcggctgttgccggtgctgtgccaggcccacggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16782 - DNA, 398 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatgtccagcggctgttgccggtgctgtgccaggcccacggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16783 - DNA, 399 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatgtccagcgcctgcttgccggtgctgtgccaggcccacggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16784 - DNA, 399 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatgtccagcgcctgcttgccggtgctgtgccaggcccacggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 16785 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagacattatggtttggctactgttgctaa

SEQ ID NO: 16786 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16787 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16788 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16789 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16790 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16791 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16792 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16793 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatggacctggtgctcaaatttcacctattgaaattgcttctcagctaccaacaactaaccctgatgcaccagttatgttggaccgaatgttgcgtctcttggcttgttacagtatcctcacttgttcagttcgtactcaacaagatggaaaggttcagagactttatggtttagctactggtactaa

SEQ ID NO: 16794 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16795 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatggacctggtgctcaaatttaacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16796 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16797 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16798 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatgctcaaatttcacctattgaaattgcttctcagctaccaacaactaaccctgatgcaccagttttgttggaccgaatgttgcgtctcttggcttgttacaatatcctcacttgttcagttcgtactcaacaagatggaaaggttcagagactttatggtttggctactgttgctaa

SEQ ID NO: 16799 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16800 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16801 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgtggctaa

SEQ ID NO: 16802 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16803 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16804 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16805 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatctaaagctggacctggtgctcaaatttcacctattgaaattgcttctcagctaccgacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16806 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16807 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16808 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatcctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16809 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16810 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16811 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16812 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagaatttatggtttggctactgttgctaa

SEQ ID NO: 16813 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatcatgctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 16814 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatcataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16815 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatcataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagcctttatggtttggctactgttgctaa

SEQ ID NO: 16816 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatcataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16817 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16818 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16819 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16820 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16821 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16822 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16823 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacttggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16824 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16825 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16826 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16827 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctacctaa

SEQ ID NO: 16828 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 16829 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16830 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16831 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16832 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgtaattgcttctcagctcccaacaactaaccctgatgcaccagttatgttggaccgaatgttgcggctcttggcttgttacaatatcctcacttgttcagttcgtactcaacaagatggaaaagttcagagactttatggtttggctactgttgctaa

SEQ ID NO: 16833 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16834 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16835 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16836 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 16837 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctcccaacatctaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16838 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16839 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttactaa

SEQ ID NO: 16840 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16841 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatgttccgtctcttggcttgttacaatatcctcacttgttcagttcgtactcaacaagatggaaagattcagagactttatggtttggctactgttgctaa

SEQ ID NO: 16842 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16843 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatattgcgtctcttggcttgttacaatatcctcacttgttctgttcgtactcaacaagatggaaaggttcagagactttatggtttggctactgttgctaa

SEQ ID NO: 16844 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16845 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctcccaacaactaaccctgatgcaccagttatattggaccgaatgttgcgtctcttggcttgttacaatatcctcacttgttcagttcgtactcaacaagatggaaaagttcagagactttatggtttggctactgttgctaa

SEQ ID NO: 16846 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccatcaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16847 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgttgcaccagttatgttggaccgaatgttgcgtctcttggcttgttacaatatcctcacttgttcagttcgtactcaacaagatggaaagattcagagactttatggtttggctactgttgctaa

SEQ ID NO: 16848 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaaagttcagagactttatggtttggctactgttgctaa

SEQ ID NO: 16849 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16850 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaacatcctcacttgttcagttcgtactcaacaagatggaaaggttcagagactttatggtttggctactgttgctaa

SEQ ID NO: 16851 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16852 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtcgctaggcttgttacaatatccacacttgtgcggttcgtactcaacaagatggaaaagttcagagactttatggtttggctacagttgcta

SEQ ID NO: 16853 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16854 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctctttgcttgttacaatatcctcacttgttcagttcgtactcaacaagatggaaagattcagagactttatggtttggctactgttgctaa

SEQ ID NO: 16855 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 16856 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 16857 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 16858 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctgctgttgctaa

SEQ ID NO: 16859 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacgagatggaaaggttcagagactttatggtttggctactgttgctaa

SEQ ID NO: 16860 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16861 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcgcttgttcagttcgtactcaacaagatggaaagattcagagactttatggtttggctactgttgctaa

SEQ ID NO: 16862 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctattgttgctaa

SEQ ID NO: 16863 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 16864 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgtggctaa

SEQ ID NO: 16865 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 16866 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcggagactttatggtttggctactgttgctaa

SEQ ID NO: 16867 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgtaaaagttcagagactttatggtttggctactgttgctaa

SEQ ID NO: 16868 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcaattcgtactcaacaagatggaaagattcagagactttatggtttggctactgttgctaa

SEQ ID NO: 16869 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 16870 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgtaa

SEQ ID NO: 16871 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggctcagagactttatggtttggcgactgttgctaa

SEQ ID NO: 16872 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 16873 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 16874 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcctctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16875 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaatcgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16876 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16877 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctactgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16878 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagtctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16879 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16880 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16881 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagtaaagctggacctggtcctcaaatttcacctattgaaattgcttctcagctcccaacaactaaccctgatgcaccagttatgttggaccgaatgttgcgtctcttggcttgttacaatatcctaacttgttcagttcgtactcaacaagatggaaaggttcagagactttatggtttggctactgttgctaa

SEQ ID NO: 16882 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16883 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16884 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16885 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16886 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16887 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgcaa

SEQ ID NO: 16888 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16889 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggcgactgttgctaa

SEQ ID NO: 16890 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 16891 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16892 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaggtgctcaaaattcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16893 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctgggcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16894 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16895 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16896 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctgttcaaattgcttctcagctaccaacaactaaccttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16897 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16898 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcggctaccaacaactaaccctgatgcaccagttatgttggaccgaatgttgcgtctcttggcttgttacaatatccgcacttgttcagttcgtactcaacaagatggaaaggttcagagactttatggtttggctactgttgctaa

SEQ ID NO: 16899 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16900 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16901 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttattttggaccgaatgttgcgtctcttggcttgttacaatatcctcacttgttcagttcgtactcaacaagatggaaagattcagagactttatggtttggctactgttgctaa

SEQ ID NO: 16902 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16903 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16904 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16905 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 16906 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16907 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcactgttgctaa

SEQ ID NO: 16908 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaatggttcagagactttatggtttggctactgttgctaa

SEQ ID NO: 16909 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgtttcaatatcctcacttgttcagttcgtactcaacaagatggaaaggttcagagactttatggtttggctactgttgctaa

SEQ ID NO: 16910 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 16911 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttctaa

SEQ ID NO: 16912 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 16913 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggtttgttacaatatcctcacttgttcagttcgtactcaacaagatggaaagattcagagactttatggtttggctactgttgttaa

SEQ ID NO: 16914 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcatcaagatggaaaagttcagagactttatggtttggctactgttgctaa

SEQ ID NO: 16915 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 16916 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 16917 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtcgcttggcttgttacaatatcctcacttgttcagttcgtacgcaacaagatggaaaggttcagagactttatggtttggctactgttgctaa

SEQ ID NO: 16918 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgtcggaccgaatgttgcgtctcttggcttgttacaatatcctcacttgttcagttcgtactcaacaagatggaaagattcagagactttatggtttggctactgttgctaa

SEQ ID NO: 16919 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16920 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 16921 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16922 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16923 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16924 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 16925 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatattgcgtctcttggcttgttacaatatcctcacttgttcagttcgtactcaacaagatggaaaggttcagagactttatggtttggctactgttgctaa

SEQ ID NO: 16926 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactctatggtttggctactgttgctaa

SEQ ID NO: 16927 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatagtttggctactgttgctaa

SEQ ID NO: 16928 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16929 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttaaaatatcctcacttgttcagttcgtactcaacaagatggaaaagttcagagactttatggtttggctactgttgctaa

SEQ ID NO: 16930 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagacattatggtttggctactgttgctaa

SEQ ID NO: 16931 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtcccttggcttgttacaatatcctcacttgttcagttcgtactcaacaagatggaaaagttcagagactttatggtttggctactgttgctaa

SEQ ID NO: 16932 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 16933 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtaatcaacaagatggaaaggttcagagactttatggtttggcactgttgctaa

SEQ ID NO: 16934 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgcaa

SEQ ID NO: 16935 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggatactgttgctaa

SEQ ID NO: 16936 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctgctgttgctaa

SEQ ID NO: 16937 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 16938 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagtctttatggtttggctactgttgctaa

SEQ ID NO: 16939 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 16940 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgagtctcttggcttgttacaatatcctcacttgttcagttcgtactcaacaagatggaaaggttcagagactttatggtttggctactgttgctaa

SEQ ID NO: 16941 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16942 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16943 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcgtctcagctaccaacaactaaccctgatgcaccagttatgttggacccaatgttgcgtctcttggcttgttacaatatcctcacttgttcagttcgtactcaacaagatggaaaggttcagagactttatggtttggctactgttgctaa

SEQ ID NO: 16944 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16945 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaattgcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16946 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatctcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16947 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctgatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16948 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggaccaggtgctcaaatttcacctattgaaattgcttctcagctaccagcaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16949 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16950 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16951 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16952 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16953 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16954 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 16955 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16956 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgcctactgttgctaa

SEQ ID NO: 16957 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtttctaa

SEQ ID NO: 16958 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16959 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtgcagagactttatggtttggctactgttgct

SEQ ID NO: 16960 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16961 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgcta

SEQ ID NO: 16962 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctaaagctggacctggtgctcaaatttcacctattgaaattgcttctcagctaccaacaactaaccctgatgcaccagttatgtgggactgaatgttgcgtctcttggcttgttacaatatcctctcttgttcagttcgtactcaacaagatggaaaagttcagagattttattatttggctactgttgctaa

SEQ ID NO: 16963 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagccggacctggtgctcaaatttcacctattgaaattgcttctcagctaccaacaactaaccctgatgcaccagttatgttggaccgaatgtttcgtctcttggcttgttacaatatcctcacttgttcagttcgtactcaacaagatggaaaagttcagagactttatggtttggctactgttgctaa

SEQ ID NO: 16964 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactgtacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16965 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16966 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggtgctcaaatttcacctattgaaattgcttctcagctgccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16967 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16968 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16969 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16970 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggtgctcaaatttcacctattgaaattgcttctcagctagcaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16971 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggtgctcaaatttcacctattgaaattgcttctcagctaccaacaactaacccttatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16972 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16973 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16974 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggtgctcaaatttcacctattgaaattgcttctcagctaccaacaactaaccctgatgcaccagttatgttggaccgaatgttgcgtctcttggcttgttacaatatcctcacttgtccagttcgtactcaacaagatggaaaggttcagagactttatggtttggctactgttgctaa

SEQ ID NO: 16975 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16976 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggtgctcaaatttcacctattgaaattgcttctcagctaccaacaactaaccctgatgcaccagttatgttggaccgaatgttgcgtctcatggcttgttacaatatcctcacttgttcagttcgtactcaacaagatggaaagattcagagactttatggtttggctactgttgctaa

SEQ ID NO: 16977 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16978 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 16979 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcatctattgaaattgcttctcagctaccaacaactaaccctgatgcaccagttatgttggaccgaatgttgcgtctcttggcttgttacaatatcctcactttttcagttcgtactcaacaagattgaaaggttcagagactttatggtttggctactgttgctaa

SEQ ID NO: 16980 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctgttcaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 16981 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16982 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16983 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 16984 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctcccaacaactaaccctgatgcaccagttatgttggactgaatgttgcgtctcttggcttgttacaatatcctcacttgttcagttcgtactcaacaagatggaaagattcagagactttatggtttggctactgttgctaa

SEQ ID NO: 16985 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16986 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16987 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16988 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 16989 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16990 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16991 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 16992 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctac

SEQ ID NO: 16993 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 16994 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctaccaacaactaaccctgatgcaccagttatgttggaccgaatgttgcgtcgcttggcttgttacaatatccccacttgttcagttcgtactcaacaagatggaaaggttcagagactttatggtttggctactgttgctaa

SEQ ID NO: 16995 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16996 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 16997 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctcccaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 16998 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 16999 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17000 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17001 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 17002 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17003 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctaccaacatctaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17004 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctaccaacaactaaccctgatgcaccagttatgtttgaccgaatgttgcgtctcttggcttgttacaatatcctcacttgttcagttcgtactcaacaagatggaaaggttcagagactttatggtttggctactgttgctaa

SEQ ID NO: 17005 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17006 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17007 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17008 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17009 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctgttgctaa

SEQ ID NO: 17010 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtttagagactttatggtttggctactgttgctaa

SEQ ID NO: 17011 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17012 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17013 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17014 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17015 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17016 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctctgttgctaa

SEQ ID NO: 17017 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacattaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17018 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17019 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17020 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17021 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17022 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17023 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17024 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17025 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacaagctgtacctggtgctcaaatttcacctgttcaaattgcttctaagcttccaacaactaaccctgatgcaccagtcatgttggaccgaatgttgcgtctcttggcttgttacaatatcctcaattgttctgttcgtactcaacaagatggaaaggttcagagactttatggtttggctactgttgctaa

SEQ ID NO: 17026 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17027 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17028 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17029 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17030 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17031 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttgcacaagataaaaatatatcatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17032 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttgcacaagataaaaatatatcatcatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17033 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttgacggatggccttctgcttagtttgatgcctggcagtttatggcgggcgtcctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17034 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttgacggatggccttctgcttagtttgatgcctggcagtttatggcgggcgtcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17035 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttgacggatggccttctgcttagtttgatgcctggcagtttatggcgggcgtcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17036 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttgacggatggccttctgcttagtttgatgcctggcagtttatggcgggcgccctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17037 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17038 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctgtacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17039 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctgggcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17040 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17041 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctcccaacacctaaccctgatgcaccagttatgttggaccgaatgttgcgtcacttggcttgttacaatatcctcacttgttcagttcgtactcaacaagatggaaaagttcagagactttatggtttggctactgttgctaa

SEQ ID NO: 17042 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17043 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17044 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17045 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17046 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttagggtttggctactgttgctaa

SEQ ID NO: 17047 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17048 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17049 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17050 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17051 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 17052 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcactcgttcagttcgtactcaacaagatggaaaggttcagagactttatggtttggctactgttgctaa

SEQ ID NO: 17053 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggtactgttgctaa

SEQ ID NO: 17054 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttgtggtttggctactgttgctaa

SEQ ID NO: 17055 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 17056 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggacctaatgttgcgtctcttggcttgttacaatatcctcacttgttcagttcgtactcaacaagatggaaaggttcagagactttatggtttggctactgttgctaa

SEQ ID NO: 17057 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggccctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttattgtttggctactgttgctaa

SEQ ID NO: 17058 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggacctggtgctcaagtttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17059 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17060 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17061 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17062 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17063 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggacctggtgctcaaatttcacctattgaaattgcttctcagctaccaacaactaaccctgatgcactagttatgttggaccaaatgttgcgtctcttggcttgttacaatatcctcacttgttcagttcgtactcaacaagatggaaagattcagagactttatggtttggctactgttgctaa

SEQ ID NO: 17064 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggacctggtgctcaaatttcacctattgaaattgcttctcagctaccaacaactaaccctgatgcacctgttatgttggaccgaatgttgcgtctcttggcttgttactatatcctcccgcgttaagttcgtactcaacaagatggaaagtttgagagcctttatggtttggctacttttgctaa

SEQ ID NO: 17065 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17066 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17067 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17068 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 17069 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17070 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaagattcagagactttatggtttggctactgtttctaa

SEQ ID NO: 17071 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 17072 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17073 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17074 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17075 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 17076 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 17077 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17078 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17079 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17080 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17081 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgcta

SEQ ID NO: 17082 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctaaatggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 17083 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctaaagctggacctggtgctcaaatttcacctgttcaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17084 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17085 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17086 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17087 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17088 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctaaagctggacctggtgctcaaatttcacctattgaaattgcttatcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17089 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctaaagcaggacctggtgctaaaatttcacctattgaaattgcttctcagctaccaacaactaaccctgatgcaccagttatgttggaccgaatgttgcgtctcttggcttgttacaatatcctcacttgttaagttcgtactcaacaagatggaaaggttcagagactttatggtttggctactgttgctaa

SEQ ID NO: 17090 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17091 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17092 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17093 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17094 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17095 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 17096 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtgtggctactgttgctaa

SEQ ID NO: 17097 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17098 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattctggacctggtgctcaaattccacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactttgctaa

SEQ ID NO: 17099 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17100 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17101 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 17102 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17103 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattctaaagctggacccggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17104 - DNA, 387 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattccgactgagcctttcgttttatttgctaaagctggacctggtgctcaaatttcacctattgaaattgcttctcagctcccaacaactatccctgatgcaccagttatgttggaccgaatgtggcgtctcttgtcttgttacaatatcctcacttgttcagttcgtactcaacaagatggaaaggttcagagactttatggtttggctactgttgctaa

SEQ ID NO: 17105 - DNA, 435 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattccagcggctgttgccgctgctgtgccaggcccacggcttgaccccggagcaggtggtggccatcgccagccacgatggcggcaagcaggcgctggaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17106 - DNA, 475 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattatgtcgtttacctatccaacgaattgtcacatgctaagattcaatgcaaatcggccacattatggccttcctagtaaaaaagggtcgaaaacgagtaatgtcctaaattaacgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17107 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattactaaatggacctggtgctcaaatttcacctattgaaattgcttctcagctaccaacaactaaccctgatgcaccagttatgttggacagaatgttgcgtctcttggcttgttacaatatcctcacttgttcagttcgtactcaacaagatggaaagattcagagactttatggtttggctaatgttgctaa

SEQ ID NO: 17108 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17109 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17110 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17111 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17112 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 17113 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattacctggtgctcaaattccacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17114 - DNA, 310 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17115 - DNA, 310 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaccaacaactaaccctgatgcaccagttatgttggaccgaatgttgcgtctcttggcttgttacaatatcctcacttgttcagttcgtactcaacaagattgaaagattcagagactttatggtttggctactgttgctaa

SEQ ID NO: 17116 - DNA, 310 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17117 - DNA, 310 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17118 - DNA, 310 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaccaacaactaaccctgatgcaccagttatcttggaccgaatgttgcgtctcttggcttgttacaatatcctcacttgttcagttcgtactcaacaagatggaaaggttcagagactttatggtttggctactgttgctaa

SEQ ID NO: 17119 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17120 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaggctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17121 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaggctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17122 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaagctggacctggtgctcaaatttcacctgttgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17123 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17124 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaagctggacctggtgctcaaatttcacctattgaaattgcttctcagctcccaacaactaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 17125 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17126 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaagctggacctggtgctcaaatttcacctattgaaattgcttctcagctaccaataactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17127 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17128 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17129 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17130 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17131 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17132 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctgttgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17133 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17134 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17135 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17136 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17137 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17138 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 17139 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggttactgttgctaa

SEQ ID NO: 17140 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17141 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagctggaaagattcagagactttatggtttggctatgttgctaa

SEQ ID NO: 17142 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcactttttctgttcgtactcaacaagatggaaaggttcagagactttatggtttggctactgttgctaa

SEQ ID NO: 17143 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggagaggttcagagactttatggtttggctactgttgctaa

SEQ ID NO: 17144 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17145 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17146 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17147 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17148 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17149 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17150 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcatctaccaacaactaaccctgatgcaccagttatgttggaccgaatgttgcgtctctttgcttgttacaatatcctcacttgttcagttcgtactcaacaagatggaaaagttcagagactttatggtttggctactgttgctaa

SEQ ID NO: 17151 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17152 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17153 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17154 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccagcaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17155 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgtttgaccgaatgttgcgtctcttggcttgttacaatatcctcacttgttcagttcgtactcaacaagatggaaagattcagagactttatggtttggctactgttgctaa

SEQ ID NO: 17156 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 17157 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttgggccgaatgtggcgtctattggcttgttacaatttcctcacttgttcagttcgtactcaacaagatggaaaggttcagagactttatggtttggctactgttgctaa

SEQ ID NO: 17158 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttgggccgaatgttgcgtctcttggcttgttacaatatcctcacttgttcagttcgtcctcaacaagatggaaaggttcagagactttatggtttggctactgttgctaa

SEQ ID NO: 17159 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17160 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17161 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17162 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagcttcagagactttatggtttggctactgttgctaa

SEQ ID NO: 17163 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgagtctcttggcttgttacaatatcctcacttgttcagttcgtactcaacaagatggaaagattcagagactttatggtttggctactgttgctaa

SEQ ID NO: 17164 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttagggtttggctactgttgctaa

SEQ ID NO: 17165 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17166 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgctcagttcgtactcaacaagatggaaaagttcagagactttatggtttggctactgttgctaa

SEQ ID NO: 17167 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatgtttggctactgttgctaa

SEQ ID NO: 17168 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 17169 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgggaaagttcagagactttatggtttggctactgttgctaa

SEQ ID NO: 17170 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgactgttgcgtctcttggcttgttacaatatcctcacttgttcagttcgtactcaacaagatggaaaggttcagagactttatggtttggctactgttgctaa

SEQ ID NO: 17171 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacgcaacaagatggaaaggttcagagactttatggtttggctactgttgctaa

SEQ ID NO: 17172 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 17173 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 17174 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatattctcacttgttcagttcgtactcaacaagatggaaaggttcagagactttatggtttggctactgttgctaa

SEQ ID NO: 17175 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 17176 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17177 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17178 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 17179 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaagattcagagactttatggtttggctactgttgctaa

SEQ ID NO: 17180 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccggttatgttggaccgaatgttgcgtctcttggcttgttacaatatcctcacttgttcagttcgtactcaacaagatggaaaggttcagagactttatggtttggctactgttgctaa

SEQ ID NO: 17181 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 17182 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17183 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17184 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17185 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 17186 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17187 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtttctaa

SEQ ID NO: 17188 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgataa

SEQ ID NO: 17189 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 17190 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgtttagttcgtactcaacaagatggaaaggttcagagactttatggtttggctactgttgctaa

SEQ ID NO: 17191 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcatctcttggcttgttacaatatcctcactttttcagttcgtactcaacaagatggaaagattcagagactttatggtttggctactgttgctaa

SEQ ID NO: 17192 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 17193 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 17194 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 17195 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 17196 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactgtatggtttggctactgttgctaa

SEQ ID NO: 17197 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggacctaatgttgtgtctcttggcttgttacaatatcctcacttgttcagttcgtactcaacaagatggaaaagttcagagactttatggtttggctactgttgctaa

SEQ ID NO: 17198 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 17199 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctattgttgctag

SEQ ID NO: 17200 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgtaaaggttcagagactttatggtttggctactgttgctaa

SEQ ID NO: 17201 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatttcctcacttgttcagtacgtactcaacaagatggaaaggttcagagactgtatggtttggctactgttgctaa

SEQ ID NO: 17202 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 17203 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcagcaagatggaaaagttcagagactttatggtttggctactgttgctaa

SEQ ID NO: 17204 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagaaactttatggtttggctactgttgctaa

SEQ ID NO: 17205 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 17206 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaaggtggaaaggttcagagactttatggtttggctactgttgctaa

SEQ ID NO: 17207 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 17208 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagacttggtggtgtggctactgttgctaa

SEQ ID NO: 17209 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcagcaagatggaaagattcagagactttatggtttggctactgttgctaa

SEQ ID NO: 17210 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctac

SEQ ID NO: 17211 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggattgttacaatatcctcacttgttcagttcgtactcaacaagatggaaagattcagagactttatggtttggctactgttgctaa

SEQ ID NO: 17212 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgtgggaccgaatgttgcggcgcttgggttgtgacaatatcctcacttgttcagttcgtactcaacaagagggaagggttcagagactgtatggtttggctagtgttgctaa

SEQ ID NO: 17213 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 17214 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 17215 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17216 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 17217 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17218 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 17219 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17220 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaactgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17221 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaactgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17222 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17223 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctatagaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17224 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcaccgattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17225 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaattccacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17226 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatctcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17227 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctaaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17228 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgcgcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17229 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17230 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17231 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgcacaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17232 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtactcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17233 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17234 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtactcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17235 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17236 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17237 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtactcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17238 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggagctcaaatttcacctattgaaattgcttctcagctcccaacaactaaccctgatgcaccagtcatgttggaccgaatgttgcatctcttagcttgttacaatatcctcacttgttcagttcgtactcaacaagatggaaaagttcagagactttatggtttggctactgttgctaa

SEQ ID NO: 17239 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctgatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17240 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggaccgggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 17241 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctgcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17242 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctgaacctgatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagaggctgtatggtttggctactgttgctaa

SEQ ID NO: 17243 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctagacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17244 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17245 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17246 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17247 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17248 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17249 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17250 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgtgctcaaatttcacctattgaaattgcttctcagctaccaacaactaaccctgatgcaccagttatgttggaccgaatgttgcgtctcttggcttgttacaatttcctcacttgttcagttcgtactcaacaagatggaaaggttcagagactttatggtttggctactgttgctaa

SEQ ID NO: 17251 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17252 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgtgctcaaatttcacctattgaaattgcttctcagctaccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 17253 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17254 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgtaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17255 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17256 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17257 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgtctactgttgctaa

SEQ ID NO: 17258 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17259 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17260 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatggtgctcaaatttcacctattgaaattgcttctcagctaccaacaactaaccctgatgcaccagttatgttggaccgaatgttgcgtctcttggcttgttacaatatcctcacttgttcatttcgtactcaacaagatggaaaggttcagagactttatggtttggctactgttg

SEQ ID NO: 17261 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17262 - DNA, 478 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgggcctggcacagcaccggcaacagccgctggaccgtctccagcgcctgcttgccaccattattgctggcgatggccaccacctgctggggggtcaagccgtgggcctggcacagcattaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17263 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17264 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatggacctggtgctcaaatttcacctattgaaattgcttctcagctcccaacaactaaccctgatgcaccagttatgttggaccgaatgttgcgtctcttggcttgttacaatatcctcacttgtccagttcgtactcaacaagatggaaagattcagagactttatggtttggctactgttgctaa

SEQ ID NO: 17265 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17266 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17267 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17268 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17269 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17270 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17271 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17272 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17273 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgctggacctggtgctcaaatttcacctattgaaattgcttctcagctaccaacaactaaccctgatgcaccggttatgttggaccgaatgttgcgtctcttggcttgttacaatatcctcacttgttcagttcgtactcaacaagatggaaaggttcagagactttatggtttggctactgttgctaa

SEQ ID NO: 17274 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17275 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17276 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17277 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgctaaagctggaccttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17278 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17279 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17280 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17281 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17282 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgacctggtgctcaaatttcacctattgaaattgcttctcagctaccgacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17283 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17284 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17285 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17286 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatgacctagtactcaaatttcacctattgaaattgcttctcagctaccaaccactaaccctgatgcaccagttatgttggaccgaatgttgcgtctcttggcttgttacaatatcctcacttgttcagttcgtactcaacaagatggaaaggttcagagactttatggtttcgctactgttgctaa

SEQ ID NO: 17287 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17288 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttgctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17289 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17290 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17291 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17292 - DNA, 319 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttctcagctaccaacaactaaccctgatgcaccagttatgttggaccgaatgttgtgtctcttggcttgttacaatatcctcacttgttcagttcgtactcaacaagatggaaaagttcagagactttatggtttggctactgttgctaa

SEQ ID NO: 17293 - DNA, 319 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17294 - DNA, 319 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17295 - DNA, 319 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17296 - DNA, 319 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 17297 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttaaagctggatctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17298 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17299 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17300 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 17301 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17302 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17303 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17304 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17305 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17306 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17307 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctagttgctaa

SEQ ID NO: 17308 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 17309 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttaaagctggacctggtgctcaaatttcacctattgaaattgcttctcagctaccaacaactaaccctgatgcaccagttatgttagaccgaatgttgcgtctcttggcttgttacaatatcctcacttgttcagttcgtactcaacaagatggaaaggttcagagactttatggtttggctactgttgctaa

SEQ ID NO: 17310 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttaaagctggacctggtgctcaaatctcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17311 - DNA, 445 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctgttgccggtgctgtgccaggcccacggcttgaccccggagcaggtggtggccatcgccagccacgatggcggcaagcaggcgctggagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17312 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggtgctcaaatttcacctattgaaattgcttctcagctcccaacaactcaccctgatgcaccagttatgttgaaccgaatgttgcgtctcttggcttgttacaatatcctctcttgttcagttcgtactcaacaagatggaaagattcagagactttatggtttggctactgttgctaa

SEQ ID NO: 17313 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17314 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17315 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17316 - DNA, 397 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggcggtggccaccacctgctggggggtcaagccgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17317 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17318 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctgttgctcaaatttcacctattgaaattgcttctcagctaccaacaactaaccctgatgcaccagttatgttggaccgaatgttgcgtctcttggcttgttacaatatcctcacttgttcagttcgttctcaacaagatggaaaggttcagagactttatggtttggctactgttgctaa

SEQ ID NO: 17319 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaactttcacctattgaaattgcttctcagctaccaacaactaaccctgatgcaccagttatgttggaccgaatgttgcgtatcttggcttgttacaatatcctcccttgttcagttcgtactcaacaagatggaaaggttcagagactttatggtttggctactgttgctaa

SEQ ID NO: 17320 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcatctgttcaaattgcttctcagcttccaacaactaaccctgatgcacctgtcatgttggaccgaatgttgcgtctcttggcttgttacaatatcctcacttgttctgttcgtactcaacaagatggaaaggttcagagactttatggtttggctactgttgctaa

SEQ ID NO: 17321 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17322 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17323 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17324 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctgttcaaattgcttctcagcttccaacaactaaccctgatgcaccagtcatgttggacctaattttgcgtctcttggcttgttacaatatcctcacttgttctgttcgtactcaacaagatggaaaggttcagagactttatggtttggctactgttactaa

SEQ ID NO: 17325 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17326 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 17327 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17328 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17329 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17330 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 17331 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17332 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17333 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggtactgttgctaa

SEQ ID NO: 17334 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17335 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17336 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctcccaacaactaaccctgatgcaccagttatgttggaccgaatgttgcgtctcttggcttggtacaatatcctcacttgttcagttcgtactcaacaagatggaaagattcagagactttatggtttggctactgttgctaa

SEQ ID NO: 17337 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctacttgctaa

SEQ ID NO: 17338 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 17339 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17340 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17341 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17342 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactttgctaa

SEQ ID NO: 17343 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatactcacttgttcagttcgtactcaacaagatggaaaggttcagagactttatggtttggctactgttgctaa

SEQ ID NO: 17344 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgcctcttggcttgttacaatatcctcacttgttcagttcgtactcaacaagatggaaaggttcagagactttatggtttggctactgttgctaa

SEQ ID NO: 17345 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17346 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaggttcagagactttatggtttggctcctgttgctaa

SEQ ID NO: 17347 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtacccaacaagatggaaagggtcagagactttatggtttggctactgttgctaa

SEQ ID NO: 17348 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgtttagttcgtactcaacaagatggaaaggttcagagactttatggtttggctactgttgctaa

SEQ ID NO: 17349 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaagattcagagactttatggtttggctactgttgctaa

SEQ ID NO: 17350 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 17351 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 17352 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctctgttgctaa

SEQ ID NO: 17353 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagagggaaaggttcagagacttgatggtttggctactgttgctaa

SEQ ID NO: 17354 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 17355 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacgtgttcagttcgtactcaacaagatggaaagattcagagactttatggtttggctactgttgctaa

SEQ ID NO: 17356 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccacttatgttggaccgaatgttgcgtctcttggcttgttacaatatcctcacttgttcagttcgtactcaacaagatggaaagattcagagactttatggtttggctactgttgctaa

SEQ ID NO: 17357 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17358 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17359 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17360 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17361 - DNA, 474 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctccagcgtctgttgccgccatcgtggctggcgatggccaccacctgccccggggacgagccgtgggccgggcacaacaccggaaacagccgctggaccggctccagcgcctgctaaagctggacctggtactcaaatttcacctattgaaattgcttctcagctaccaacaactagccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17362 - DNA, 430 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctccagcgcctgcttgccaccgccattgctggcgatggccaccacctgctggggggtcaagccgtgggcctaaagctgcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17363 - DNA, 427 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctccagcgcctgcttgccaccgccattgctggcgatggccaccacctgctggggggtcaagccgtgctcaagccggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17364 - DNA, 427 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctccagcgcctgcttgccaccgccattgctggcgatggccaccacctgctggggggtcaagccgtgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17365 - DNA, 427 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctccagcgcctgcttgccaccgccattgctggcgatggccaccacctgctggggggtcaagccgtgctaaagctgcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17366 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctccagcgccggcctgccgccgccattgccatctaaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaggttcagaggctttatggtttggctactgttgctaa

SEQ ID NO: 17367 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctccagcgccggcctgccgccgccattgccatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17368 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctccagcgccggcctgccgccgccattgccatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 17369 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctatagctggacctggtgcacaaatttcacctattgaaattgcttctcagctaccaacatctaaccctgaagcaccagttatgttggaccgaatgttgcgtctcttggcttgttacaatatcctcacttgttcagttcgtactcaacaagatggaaaagttcagagactttatggtttggctactgttgctaa

SEQ ID NO: 17370 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17371 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17372 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcgaa

SEQ ID NO: 17373 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 17374 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctacagctggacctggtgctcaaatttcacctattgaaattgcttctcagctaccaacaactaaccctgatgcaccagttatgttggacagaatgttgcgtcacttggcttgttacaatatcctcacttgttcagttcgtactcaacaagatggaaaggttcagagactttatagtttgggtactgttgctaa

SEQ ID NO: 17375 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17376 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaagctggacctggtgctcaaatttcacctgttcaaattgcttctcagcttccaacaactatccctgatgcaccagtcatgttggaccgaatgttgcgtctcttggcttgttacaatatcctcacttgttcagtgcgtactcaacaagatggaaaggttcagagactttatggtttggctaatgttgcgaa

SEQ ID NO: 17377 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17378 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17379 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17380 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17381 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17382 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17383 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtt

SEQ ID NO: 17384 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 17385 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaacgctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17386 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaacgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17387 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17388 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17389 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17390 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17391 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggtcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17392 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctgggcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17393 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggatctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17394 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctgttgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17395 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggttctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17396 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17397 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17398 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17399 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17400 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17401 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctgttcaaattgcttctcagcttccaacaactaaccctgatgcaccagtcgtgttggaccgaatgttgcgtctcttggcttgttacaatatcctcacttgttctgttcgtactcaacaagatggaaaggttcagagactttatggtttggctactgttgctaa

SEQ ID NO: 17402 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17403 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17404 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtattcaacaagatggaaaggttcagagactttatggtttggctactgttgctaa

SEQ ID NO: 17405 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggccactgttgctaa

SEQ ID NO: 17406 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 17407 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctgttcaaattgcttctcagcttccaacaactaaccctgatgcaccagtcatgttggaccgaatgttgtgtctcttggcttgttacaatatcctcacttgttctgttcgtactcaacaagatggaaaggttcagagactttatggtttggctactgttgctaa

SEQ ID NO: 17408 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17409 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17410 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 17411 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17412 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17413 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctatttatattgcttctcagctaccaacaactaaccctgatgcaccagttatgttggtccgaatgttgcgtctcttgggttgttacaatatcctcactttttcagttcgtactcaacaagagtgaaaggttcagagactttatggtttggctactgttgcgaa

SEQ ID NO: 17414 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctatttaaattgcttctcagctaccaacatctaaccctgatgcaccagttatgttgaaccgaatgtttcgtctctttgcttgttacaatatcctcactttttcagttcgtactcaacaagatggaaagtttcagagtccttattgtttggctacttttgctaa

SEQ ID NO: 17415 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgagattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17416 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaagttgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17417 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17418 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17419 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17420 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggcttctgttgctaa

SEQ ID NO: 17421 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacgactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17422 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgattcaccagttatgttggaccgaatgttgcctctcttggcttgttacaatatcctcacttgttcagttcgtactcaacaagatggaaaggttcagagactttatggtttggctactgttgctaa

SEQ ID NO: 17423 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgtttgaccgaatgttgcgtctcttggcttgttacaatatcctcacttgttctgttcgtacccaacaagatggaaaggttcagagactttatggtttggctactgttgctaa

SEQ ID NO: 17424 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17425 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17426 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatggaaaagttcagagactttatggtttggctactgttgctaa

SEQ ID NO: 17427 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17428 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcactttttcggtccgtactcaacaagatggaaagtttcagagacttaatggttggctactgttgctaa

SEQ ID NO: 17429 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 17430 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggactgaatgttgcgtctcttggcttgttacaatatcctcacttgttcagttcgtactcaacaagatggaaaggttcagagactttatggtttggctactgttgctaa

SEQ ID NO: 17431 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatgggttggctactgttgctaa

SEQ ID NO: 17432 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 17433 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctctgttgctaa

SEQ ID NO: 17434 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 17435 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgtaacaatatcctcacttgttcagttcgtactcaacaagatggaaaggttcagagactttatggtttggctactgttgctaa

SEQ ID NO: 17436 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 17437 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgctcagttcgtactcaacaagatggaaaggttcagagactttatggtttggctactgttgctaa

SEQ ID NO: 17438 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgcactcaacaagatggaaagattcagagactttatggtttggctactgttgctaa

SEQ ID NO: 17439 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17440 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcagcaagatggaaagattcagagactttatggtttggctactgttgctaa

SEQ ID NO: 17441 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgtttagttcgtactcaacaagatggaaaggttcagagactttatggtttggctactgttgctaa

SEQ ID NO: 17442 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacgagatggaaagattcagagactttatggtttggctactgttgctaa

SEQ ID NO: 17443 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 17444 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtgctaa

SEQ ID NO: 17445 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaattttgcgtctcttggcttgttacaatatcctcacttgttcagttcgtactcaacaagatggaaaggttcagagactttatggtttggctactgttgctaa

SEQ ID NO: 17446 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattccgagactttatggtttggctactgttgctaa

SEQ ID NO: 17447 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagacggaaaggttcagagactttatggtttggctactgtttaa

SEQ ID NO: 17448 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaataacctcacttgttcagttcgtactcaacaagatggaaagattcagagactttatggtttggctactgttgctaa

SEQ ID NO: 17449 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 17450 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagtccgtactcaacaagatggaaagattcagagactttatggtttggctactgttgctaa

SEQ ID NO: 17451 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17452 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 17453 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 17454 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17455 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgacgcaccagttatgttggaccgaatgttgcgtctcttggcttgttacaatatcctcacttgttcagttcgtactcaacaagatggaaagattcagagactttatggtttggctactgttgctaa

SEQ ID NO: 17456 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17457 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17458 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaataactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17459 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaatcctgatgcacccgttatgttcgaccgaatgttgcgactcttggcttgttacaatatcctcacttcttcagttcgtactcaacaagatggaaaggttccgagactttatggtttggctactgttgctaa

SEQ ID NO: 17460 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaatcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17461 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaagattcagagactttatggtttggctactgttgctaa

SEQ ID NO: 17462 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaagattcagagactttatggtttggctactgttgctaa

SEQ ID NO: 17463 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaaagttcagagactttatggtttggctactgttgctaa

SEQ ID NO: 17464 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17465 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 17466 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17467 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcgcttgttcagttcgtactcaacaagatggaaaagttcagagactttatggtttggctactgttgctaa

SEQ ID NO: 17468 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 17469 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttcttacaatatcctcacttgttcagttcgtactcaacaagatggaaaggttcagagactttatggtttggctactgttgctaa

SEQ ID NO: 17470 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagtttgtactcaacaagatggaaaggttcagagactttatggtttggctactgttgctaa

SEQ ID NO: 17471 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtcttttggcttgttacaatatcctcacttgttcagttcgtactcaacaagatggaaaggttcagagactttatggtttggctactgttgctaa

SEQ ID NO: 17472 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaattttgcgtctcttggcttgttacactatcctcacttgttcagttcgtactcaacaagatggaaaggttcagagactttatggtttggctactgttgctaa

SEQ ID NO: 17473 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17474 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctatgttgctaa

SEQ ID NO: 17475 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttg

SEQ ID NO: 17476 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 17477 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 17478 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcactagttcagttcgtactcaacaagatggaaaggttcagagactttatggtttggctactgttgctaa

SEQ ID NO: 17479 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 17480 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17481 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 17482 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttataatatcctcacttgttcagttcgtactcaacaagatggaaaggttcagagactttatggtttggctactgttgctaa

SEQ ID NO: 17483 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 17484 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgtaa

SEQ ID NO: 17485 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagggactttatggtttggctactgttgctaa

SEQ ID NO: 17486 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcaaagactttatggtttggctactgttgctaa

SEQ ID NO: 17487 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggacctaatgttgcgtctcttggcttgttacaatatcctcacttgttcagttcgtactcaacaagatggaatggttcagagactttatggtttggctactgttgctaa

SEQ ID NO: 17488 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgatgctaa

SEQ ID NO: 17489 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtaatcaacaagatggaaaagttcagagactttatggtttgctactgttgctaa

SEQ ID NO: 17490 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggagaggttcagagactttatggtttggctactgttgctaa

SEQ ID NO: 17491 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcatttcgtactcaacaagatggaaaggttcagagactttatcgtttggctactgttgctaa

SEQ ID NO: 17492 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggagaggttcagagactttatggtttggctactgttgctaa

SEQ ID NO: 17493 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgtttcaatatcctcacttgttcagttcgtactcaacaagatggaaaggttcagagactttatggtttggctactgttgctaa

SEQ ID NO: 17494 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgcctcttggcttgttacaatatcctcacttgttcagttcgtactcaacaagatggaaaggttcagagactttatggtttggcgactgttgctaa

SEQ ID NO: 17495 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 17496 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatgctcacttgtgcagttcgtactcaacaagatggaaaggttcagagactttatggtttggctactggtgctaa

SEQ ID NO: 17497 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcatctcttggcttgttacaatatcctcacttgttcagttcgtactcaacaagatggaaaggttcagagactttatggtttggctactgttgctaa

SEQ ID NO: 17498 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagttcagagactttatggtttggctactgttgctaa

SEQ ID NO: 17499 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttattgtctggataatcttgctaa

SEQ ID NO: 17500 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgtgtctcttggcttgttacaatatcctcacttgtacagttcgtactcaacaagatggaaaggttcagagactttatggtttggctactgttgctaa

SEQ ID NO: 17501 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 17502 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactatatggtttggctactgttgctaa

SEQ ID NO: 17503 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 17504 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 17505 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 17506 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 17507 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 17508 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatggtgcggcgcggggcgggggacaagagccgcacgggggaagggcggacgcaacaagagggaaaggtgcagagacgtgaggggttggctactgttgctaa

SEQ ID NO: 17509 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgtaaaggttcagagactttatggtttggctactgttgctaa

SEQ ID NO: 17510 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgatacaatatcctcacttgttcagttcgtactcaacaagatggaaagattcagagacttgatggtttggctactgttgctaa

SEQ ID NO: 17511 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggctggttacaatatcctcacttgttcagttcgtactcaacaagatggaaagattcagagactttatggtttggctactgttgctaa

SEQ ID NO: 17512 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaattttgcgtctcttggcttgttacaatatcctcacttgttcagttcgtactcaacaagatggaaaggttcagagactttatggtttggctactgttgctaa

SEQ ID NO: 17513 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagaggctttatggtttggctactgttgctaa

SEQ ID NO: 17514 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagtctttatggtttggctactgttgctaa

SEQ ID NO: 17515 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagtccgtactcaacaagatggaaagattcagagactttatggtttggctactgttgctaa

SEQ ID NO: 17516 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactggtgctaa

SEQ ID NO: 17517 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctctcggcttgttacaatatcctcacttgttcagttcgtactcaacaagatggaaaagttcagagactttatggtttggctactgttgctaa

SEQ ID NO: 17518 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 17519 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcactttttcagttcgtactcaacaagaaggaaaggttcagagaccttatggtttggctactgttgctaa

SEQ ID NO: 17520 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttactatatcctcacttgttcagttcgtactcaacaagatggaaaggttcagagactttatggtttggctactgttgctaa

SEQ ID NO: 17521 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 17522 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacgtgttcagttcgtactcaacaagatggaaaggttcagagactttatggtttggctactgttgctaa

SEQ ID NO: 17523 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaagattcagagactttatggtttggctactgttgctaa

SEQ ID NO: 17524 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttataatatcctcacttgttcagttcgtactcaacaagatggaaagattcagagactttatggtttggctactgttgctaa

SEQ ID NO: 17525 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacagtatcctcacttgttcagttcgtactcaacaagatggaaaggttcagagactttatggtttggctactgttgctaa

SEQ ID NO: 17526 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcgtgttacaatatcctcacttgttcagttcgtactcaacaagatggaaaggttcagagactttatggttgggctactgttgctaa

SEQ ID NO: 17527 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgcctcttggcttgttacaatatcctcacttgttcagttcgtactcaacaagatggaaaggttcagagactttatggtttggctactgttgctaa

SEQ ID NO: 17528 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcatttcgtactcaacaagatggaaagtttcagagactttatggtttggctactgttgctaa

SEQ ID NO: 17529 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggactgaatgttgcgtctcttggcttgttacaatatcctcacttgttcagttcgtactcaacaagatggaaaggttcagagactttatggtttggctactgttgctaa

SEQ ID NO: 17530 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaacgaatgttgcgtctcttggcttgttacaatatcctcacttgttcagttcgtactcaacaagatggaaaggttcagagactttatggtttggctactgttgctaa

SEQ ID NO: 17531 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaaa

SEQ ID NO: 17532 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcctgttgctaa

SEQ ID NO: 17533 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaataagatggaaaagttcagagactttatggtttggctactgttgctaa

SEQ ID NO: 17534 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcagcaagatggaaaggttcagagactttatggtttggctactgttgctaa

SEQ ID NO: 17535 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 17536 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 17537 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtcccttggcttgttacaatatcctcacttgttcagttcgtactcaacaagatggaaaggttcagagactttatggtttggctactgttgctaa

SEQ ID NO: 17538 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgggaagattcagagactttatggtttggctactgttgctaa

SEQ ID NO: 17539 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 17540 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17541 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17542 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagctatgttggaccgaatgttgcgtctcttggcttgttacaatatcctcacttgttcagttcgtactcaacaagatggaaagattcagagactttatggtttggctactgttgctaa

SEQ ID NO: 17543 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 17544 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17545 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17546 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagcccccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17547 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagccaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17548 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcacctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17549 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcctctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17550 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattacttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17551 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaatcgcttctcagctaccaacaactaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 17552 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaatcgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17553 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17554 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttaacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17555 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatctcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17556 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17557 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17558 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgcacaaatttcacctattgaaattgcttctgagctaccaaaaactaaccctgatgcaccagttatgttggaccgaatgttgcgtctcttggctggttacaatatcctcacttgttcagttcgtactcaacaagatggaaaggttcagagactttattgtttggctactgatgctaa

SEQ ID NO: 17559 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17560 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtactcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 17561 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggggctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17562 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggagctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17563 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctcgtgctcaaatttcacttattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17564 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctagtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17565 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacccggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17566 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctgaacctggtgctcaaatttcacctattgaaattgcttctcagctcccaacaactaaccctgatgcaccagttatgttggaccgaatgttgcgtctcttggcttgttacattatcctcacttgttcagttcgtactcaacaagatggaaaggttcagagactttatggtttggctactgttgctaa

SEQ ID NO: 17567 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagccggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17568 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagccggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17569 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagccggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17570 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaacctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17571 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17572 - DNA, 413 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgtggggcacgtacttcagcttgtgcctcaactcggatttcttctcctccagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17573 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17574 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17575 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17576 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17577 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgtgctcaaatttcacctattgaaattgcttctcagctaccaacaactaaccctgatgcaccagttatgttggaccgaatgttgcgtctcttggcttgttacaatatcctcacttgttcagttcgtactcaacaagatagaaagattcagagactttatggtttggctactgttgctaa

SEQ ID NO: 17578 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17579 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17580 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 17581 - DNA, 395 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgtcgattgtcttcattggatcggatcccatcccctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17582 - DNA, 395 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgtcgattgtcttcattggatcggatcccatcccctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 17583 - DNA, 395 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgtcgattgtcttcattggatcggatcccatcccctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17584 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcggcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17585 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcggcagcgttagggaccgtcgctgtcaagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17586 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcggcagcgttagggaccgtcgctgtcaagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17587 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcggcagcgttagggaccgtcgctgtcaagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17588 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctggacctggtgctcaaatttcacctattgaaattgcttctcagctgccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17589 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17590 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17591 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17592 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17593 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17594 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17595 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 17596 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtatggctactgttgctaa

SEQ ID NO: 17597 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgtgacaatatcctcacttgttctgttcgtactcaacaagatggaaaggttcagagaatttatggtttggttactgttgctaa

SEQ ID NO: 17598 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtttctaa

SEQ ID NO: 17599 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctggacctggtgctcaaatttcacctattgaaattgcttctcagctaccaacaactaaccctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 17600 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctacagctggacctagtgctcaaatttcacctattgaaattgcttctcagctcccaacaactaaccctgatgcaccagttatgttggaccgaatgttgcgtcacttggcttgttacaatatcctcacttgttcagttcgtactcaacaagatggaaagattcagagactttatggtttggctactgttgctaa

SEQ ID NO: 17601 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17602 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17603 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17604 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctat

SEQ ID NO: 17605 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctaaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatagaaaggttaagagccttggtggtttggctactgttactaa

SEQ ID NO: 17606 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17607 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17608 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17609 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 17610 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17611 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 17612 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgacctggtgctcaaatttcacctattgaaatttcttctcagctaccaacaactaaccctgatgcaccagttatgttggaccgaattttgcgtctcttggcttgttacaatatcctcacttgttcagttcgtactcaacaagatggaaaggttcagagactttatggttcggctactgttgctaa

SEQ ID NO: 17613 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17614 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17615 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17616 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17617 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17618 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 17619 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17620 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17621 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17622 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17623 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17624 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggtgctcaaatttcacctattgaaatcgcttctcagctaccaacaactaaccctgatgcaccagttatgttggaccgaatgttgcgtctcttggcttgttacaatatccgcacttgttcagttcgtactcaacaagatggaaaggttcagagactttatggtttggctactgttgctaa

SEQ ID NO: 17625 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttctcctattgaaattgcttctcagctcccaacaactaaccctgatgcaccagttatgttggactgaatgttgcgtctcttggcttgttacaatagcctcacttgttcagttcgtactcaacaagatggaaaggttcagagactttatggtttggctactgttgctaa

SEQ ID NO: 17626 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17627 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagagggaaaggttcagagactttatggtttggctactgttgctaa

SEQ ID NO: 17628 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17629 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17630 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17631 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcgaa

SEQ ID NO: 17632 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 17633 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagcctttatggtttggctactgttgctaa

SEQ ID NO: 17634 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttcacctattgaaattgcttctcagctaccagcaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17635 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17636 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17637 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17638 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgctcagttcgtactcaacaagatggaaaagttcagagactttatggtttggctactgttgctaa

SEQ ID NO: 17639 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaagttcagagactttatggtttggctactgttgctaa

SEQ ID NO: 17640 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17641 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggacctggtgctcaaatttcacctattgaaattgcttctcagctaccaacaactaaccctgatccaccagttatgttggaccgaatgttgcgtctcttggcttgttacaatatcctcacttgttcagttcgtactcaacaagatggaaaggttcagagactttatggtttggctactgttgctaa

SEQ ID NO: 17642 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagaaggaaagattcagagactttatggtttggctactgttgctaa

SEQ ID NO: 17643 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagcttcacctggtgctcaaatttcacctattgaaattgcttctcagctcccaactactaaccctgatgcaccagttatgttggaccgaatgttgcgtctcttggcttgttacaatatcctcacttgttcagttcgtactcaacaagatggaaaggttcagagactttattgtttggctactgttgctaa

SEQ ID NO: 17644 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctgttgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17645 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17646 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17647 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 17648 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctcccaacaactaaccctgatgcaccagttattttggaccgaatgttgcgtctcttggcttgttacaatatcctcacttgttcagttcgtactcaacaagatggaaaggttcagagactttatggtttggctactgttgctaa

SEQ ID NO: 17649 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17650 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17651 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17652 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 17653 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 17654 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaattaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17655 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17656 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17657 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaagattcagagactttatggtttggctactgttgctaa

SEQ ID NO: 17658 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaggttcagagcctctatggtttggctactgttgctaa

SEQ ID NO: 17659 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttacgtctcttggcttgttacaatatcctcacttgttcagttcgtactcaacaagatggaaaggttcagagactttatggtttggctactgttgctaa

SEQ ID NO: 17660 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcgtggcttgttacaatatcctcacttgttcagttcgtactcaacaagatggaaaggttcagagactttatggtttggctactgttgctaa

SEQ ID NO: 17661 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgtagctaa

SEQ ID NO: 17662 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 17663 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17664 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttattgtttggctactgttgctaa

SEQ ID NO: 17665 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtcgcttggcttgttacaatatcctcacttgttcagttcgtactcaacaagatggaaagattcagagactttagggtttggctactgttgctaa

SEQ ID NO: 17666 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17667 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctgcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17668 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17669 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17670 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17671 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17672 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccgctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17673 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccgctggacctggtgctcaaatttcacctattgaaattgcttctcagctaccaacaactaaccctgatgcaccagttatgttggaccgaatgttgcgtctcttggcttgttacaatatcctcacttgtgcagttcgtactcaacaagatggaaaggttcagagactttatggtttgctactgttgctaa

SEQ ID NO: 17674 - DNA, 456 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccgccatcgtggctggcgatggccaccacctgctccggggtcaagccgtgggcctggcacagcaccggcaacagccgctggaccgtctccagcgcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17675 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaccacctgctggggggtcaagccgtgggtctggcacagcaccggcaacagccgctggaccgtctccagcgcctgcttgccgccatcgtggctgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17676 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaccacctgctggggggtcaagccgtgggcctggcacagcaccggcaccagccgctggaccgtctccagcgcctgcttgccgccatcgtggctgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17677 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaccacctgctggggggtcaagccgtgggcctggcacagcaccggcaacagccgctggaccgtctccagcgcctgcttgccgccatcgtggctgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17678 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaccacctgctggggggtcaagccgtgggcctggcacagcaccggcaacagccgctggaccgtctccagcgcctgcttgccgccatcgtggctgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtacagagactttatggtttggctactgttgctaa

SEQ ID NO: 17679 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaccacctgctggggggtcaagccgtgggcctggcacagcaccggcaacagccgctggaccgtctccagcgcctgcttgccgccatcgtggctgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17680 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaccacctgctggggggtcaagccgtgggcctggcacagcaccggcaacagccgctggaccgtctccagcgcctgcttgccgccatcgtggctgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17681 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaccacctgctggggggtcaagccgtgggcctggcacagcaccggcaacagccgctggaccgtctccagcgcctgcttgccgccatcgtggctgctggacctggtgctcaaatttcacttattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17682 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaccacctgctggggggtcaagccgtgggcctggcacagcaccggcaacagccgctggaccgtctccagcgcctgcttgccgccatcgtggctgctggacctggtgctcaaatttcacctattgaaattgcttctcaactaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17683 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17684 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17685 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17686 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17687 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 17688 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17689 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaagctggacctggtgctcaaatttcacctattgaaattgcttctcagctaccaacaactaaccctgatgcaccagttatgttggaccgaatgtcgcgtctcttggcttgttacaatatcctcacttgttcagttcgtactcaacaagatggaaaagttcagagactttatggtttggctactgttgctaa

SEQ ID NO: 17690 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17691 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 17692 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttggacctggtgctcaaatttcacctgttgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17693 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17694 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17695 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17696 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17697 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17698 - DNA, 367 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17699 - DNA, 367 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17700 - DNA, 367 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17701 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17702 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17703 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17704 - DNA, 432 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttacgccaacggttgaagtgccgatttgcggtcacgcgacagtagctgcgcactatgtacgtgcgaaggtgaagctggacctggtgctcaaatttctcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17705 - DNA, 432 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttacgccaacggttgaagtgccgatttgcggtcacgcgacagtagctgcgcactatgtacgtgcgaaggtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17706 - DNA, 432 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttacgccaacggttgaagtgccgatttgcggtcacgcgacagtagctgcgcactatgtacgtgcgaaggtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17707 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17708 - DNA, 383 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgtgacgctcaagtcagaggtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17709 - DNA, 383 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgtgacgctcaagtcagaggtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17710 - DNA, 383 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgtgacgctcaagtcagaggtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17711 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgtaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17712 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17713 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17714 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17715 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17716 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17717 - DNA, 438 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgtaaaaaggccgcgttgctggcgtttttccataggctccctctggcaacgctgcgatcatgtcctgatacttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17718 - DNA, 472 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggtggccatcgccagcaatggcggtggcaagcaggcgctggagacggtccagcggctgttgccggtgctgtgccaggcccacggcttgaccccggagcaggtggtggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17719 - DNA, 472 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggtggccatcgccagcaatggcggtggcaagcaggcgctggagacggtccagcggctgttgccggtgctgtgccaggcccacggcttgaccccggagcaggtggtggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17720 - DNA, 472 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggtggccatcgccagcaatggcggtggcaagcaggcgctggagacggtccagcggctgttgccggtgctgtgccaggcccacggcttgaccccggagcaggtggtggctaaagctggacctggtgctcaaatttcacctattgaaattgcttctcagctcccatcaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17721 - DNA, 472 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggtggccatcgccagcaatggcggtggcaagcaggcgctggagacggtccagcggctgttgccggtgctgtgccaggcccacggcttgaccccggagcaggtggtggctcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17722 - DNA, 472 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggtggccatcgccagcaatggcggtggcaagcaggcgctggagacggtccagcggctgttgccggtgctgtgccaggcccacggcttgaccccggagcaggtggtggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17723 - DNA, 472 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggtggccatcgccagcaatggcggtggcaagcaggcgctggagacggtccagcggcggttgccggtgctgtgccaggcccacggcttgaccccggagcaggtggtggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17724 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17725 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17726 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggtgctcaaatttcacctattgaaattgcttctcagctcccaacaactaaccctgatgcaccagttatgttggaccgaatgttgcgtctcttggcttgttacaatatcctcacttattcagttcgtactcaacaagatggaaaggttcagagactttatggtttggctactgttgctaa

SEQ ID NO: 17727 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgggcctggcacagcaccggcaacagccgctggaccgtctccagcggctgcttgccgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17728 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgggcctggcacagcaccggcaacagccgctggaccgtctccagcggctgcttgccgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17729 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgggcctggcacagcaccggcaacagccgctggaccgtctccagcgcctgcttgccgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17730 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgggcctggcacagcaccggcaacagccgctggaccgtctccagcgcctgcttgccgctaaagctggacctggtgctcaaatttcacctattgaaattgcttctcagctaccaacaactaaccctgattcaccagttatgttggaccgaatgttgcgtctcttggcttgttacaatatcctcacttgttcagttcgtactcaacaagatggaaagattcagagactttatggtttggctactgttgctaa

SEQ ID NO: 17731 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgggcctggcacagcaccggcaacagccgctggaccgtctccagcgcctgcttgccgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17732 - DNA, 433 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggcgatggccaccacctgctccggggtcaagccgtgggcctggcacagcaccgccaacagcccctgagctgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17733 - DNA, 420 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggagacggtccagcggctgttgccggtgctgtgccaggcccacggcttgacccccctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17734 - DNA, 420 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggagacggtccagcggctgttgccggtgctgtgccaggcccacggcttgacccccctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17735 - DNA, 420 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggagacggtccagcggctgttgccggtgctgtgccaggcccacggcttgacccccctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17736 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggacctggtgctcaaatttcacctgttcacattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 17737 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 17738 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17739 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17740 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggacctggtgctcaaatttcacctgttcaaattgcttctcagcttccaacaactaaccctgatgcaccagtcatgttggaccgaatgttgcgtcgcttggcttgttacaatatcctcacttgttcagttcgtactcaacaagatggaaagattcagagactttatggtttggctactgttgctaa

SEQ ID NO: 17741 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17742 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17743 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17744 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17745 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17746 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17747 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17748 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 17749 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 17750 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctgttgccggtgctgtgccaggcccacggcttgaccccccagcaggtggtggccatcgccagcaatattggtggcaagcaggcgctgaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17751 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctgttgccggtgctgtgccaggcccacggcttgaccccccagcaggtggtggccatcgccagcaataatggtggcaagcaggcgctgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17752 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctggtgctgtgccaggcccacggcttgaccccggagcaggtggtggccatcgccagccacgatggcggcaagcaggcgctggacctacagctggacctggtgctcaaatttcacctattgaaatttcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17753 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctggcgatggccaccacctgctccctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17754 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctggagacggtccagcggctgttgccggtgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17755 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17756 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17757 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17758 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctgctcaaatttcgcctattgaaattgcttctcagctcccaacaactaaccctgatccaccagttatgttggaccgaatgttgcgtcacttggcttgttacaatatcctcacttgttcagttcgtactcaacaagatggaaagattcagagactttatggtttggctactgttgctaa

SEQ ID NO: 17759 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaagctggacctggtgctcaaatttcatctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17760 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17761 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaagctggacctggtgctcaaatttcacctattgaaattgcttctcagctcccaacaactaaccctgatgcaccagttatgttggaccgaatgttgcgtctcttggcttgttacaatatcctcacttgttcagttcgcactcaacaagatggaaaggttcagagactttatggtttggctatgttgctaa

SEQ ID NO: 17762 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17763 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaagctggacctggtgctcaaatttcacctattgaaattgcttctcagctaccaataactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17764 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17765 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17766 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaagctggacctggtgctcaaatttcacctattgaaattgcttctcagctaccaacaactaaccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 17767 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctctgttgctaa

SEQ ID NO: 17768 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17769 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttgggtactgttgctaa

SEQ ID NO: 17770 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaactggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17771 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccgtgggcctggcacagcaccggcaacagcgcctgcaccgtctccagcgcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17772 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccgtgggcctggcacagcaccggcaacagcgcctgcaccgtctccagcgcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17773 - DNA, 450 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccggtgctgtgccaggcccacggcttggccccggagcaggtggtggccatcgccagcaacgatggcggcaagcaggcgctggacctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17774 - DNA, 434 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccggtgctgtgccaggcccacggcttgaccccggagcaggtggtggccgtcgccagcaatggcggtggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17775 - DNA, 434 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccggtgctgtgccaggcccacggcttgaccccggagcaggtggtggccatcgccagcaatggcggtggctacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17776 - DNA, 434 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccggtgctgtgccaggcccacggcttgaccccggagcaggtggtggccatcgccagcaatggcggtggctaaagctggacctggttctcaaatttcacctgttcaaattgcttctcagcttccaacaactaaccctgatgcaccagtcatgttggaccgaatgttgcgtctcttggcttgttacaatatcctcacttgttccgttcgtactcaacaagatggaaaggttcagagactttatggtttggctactgttgctaa

SEQ ID NO: 17777 - DNA, 434 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccggtgctgtgccaggcccacggcttgaccccggagcaggtggtggccatcgccagcaatggcggtggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17778 - DNA, 473 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccggtgctgtgccaggcccacggcttgaccccggagcaggtggtggccatcgccagcaatggcggcggcaggccggcggtggagatcattgttgcacagttatctcgccctgattggacctggtgctcaaatttcacctattgaaattgcttcgcagctaccaacaactagccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17779 - DNA, 473 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccggtgctgtgccaggcccacggcttgaccccggagcaggtggtggccatcgccagcaatggcggcggcaggccggcgctggagagcattgttgcccagttatctcgccctgattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17780 - DNA, 473 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccggtgctgtgccaggcccacggcttgaccccggagcaggtggtggccatcgccagcaatggcggcggcaggccggcgctggagagcattgttgcccagttatctcgccctgattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17781 - DNA, 434 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccggtgctgtgccaggcccacggcttgaccccccagcaggtggtggccatcgccagcaatggcggtggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17782 - DNA, 434 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccggtgctgtgccaggcccacggcttgaccccccagcaggtggtggccatcgccagcaatggcggtggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaataagatggaaaggttcagagactttatggtttggctactgttgctaa

SEQ ID NO: 17783 - DNA, 434 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccggtgctgtgccaggcccacggcttgaccccccagcaggtggtggccatcgccagcaatggcggtggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17784 - DNA, 434 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccggtgctgtgccaggcccacggcttgaccccccagcaggtggtggccatcgccagcaatggcggtggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17785 - DNA, 434 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccggtgctgtgccaggcccacggcttgaccccccagcaggtggtggccatcgccagcaatggcggtggctaaagctggacctggtgctcaaattccacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17786 - DNA, 434 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccggtgctgtgccaggcccacggcttgaccccccagcaggtggtggccatcaccagcaatggcggtggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17787 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccggtgctgtgccaggcccacggcttgaccccccagcaggtggtggccataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17788 - DNA, 429 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccgccatcgtggctggcgatggccaccacctgctccggggtcaagccgtgggcctggcacaggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaaccagatggaaaagttcagagactttatggtttggctactgttgctaa

SEQ ID NO: 17789 - DNA, 429 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccgccatcgtggctggcgatggccaccacctgctccggggtcaagccgtgggcctggcacaggctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17790 - DNA, 429 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccgccatcgtggctggcgatggccaccacctgctccggggtcaagccgtgggcctggcacaggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17791 - DNA, 429 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccgccatcgtggctggcgatggccaccacctgctccggggtcaagccgtgggcctggcacaggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17792 - DNA, 429 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccgccatcgtggctggcgatggccaccacctgctccggggtcaagccgtgggcctggcacaggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17793 - DNA, 428 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccgccatcgtggctggcgatggccaccacctgctccggggtcaagccgtgggcctggcacaggctaaagctggacctggtgctcaaattgcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 17794 - DNA, 429 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccgccatcgtggctggcgatggccaccacctgctccggggtcaagccgcggtcctggcacaggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttattgtttgggtactgtggctaa

SEQ ID NO: 17795 - DNA, 406 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgcccacggcttgaccccggagcaggtgttggccatcgccagctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17796 - DNA, 406 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgcccacggcttgaccccggagcaggtggtggccatcgccagctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 17797 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccaccgccattgctggcgatggccaccacctgctggggggtcaagccgtgggccgggcacagcaccggcaacagacgctggacctaaagctggacctggtgctcaaatttcacctgttcaaattgcttctcagctcacaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17798 - DNA, 429 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgcaacgcaattaatacgcgtaccgctagccaggaagagtttgtagaaacgcaaaaaggccatccgtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17799 - DNA, 429 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgcaacgcaattaatacgcgtaccgctagccaggaagagtttgtagaaacgcaaaaaggccatccgtaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17800 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgaccgagttcaagttcctgttcgtgtccgtcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17801 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgaccgagttcaagttcctgttcgtgtccggcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17802 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgaccgagttcaagttcctgttcgtgtccggcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17803 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgaccgagttcaagttcctgttcgtgtccggcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17804 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgaccgagttcaagttcctgttcgtgtccggcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17805 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgaccgagttcaagttcctgttcgtgtccggcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17806 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgaccgagttcaagttcctgttcgtgtccggcctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17807 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgaccgagttcaagttcctgttcgtgtccggcctaaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17808 - DNA, 435 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgaccccggagcaggtggtggccatcgccagccacgatggcggcaagcaggcgctggagacggtccagcggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17809 - DNA, 435 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgaccccggagcaggtggtggccatcgccagcaacgatggcggcaagccggcgctggagacggtccagcggctaaagctggacctggtgctcaaatttcgcctattgatgttgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17810 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgaccccccagcaggtggtggccatcgtaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 17811 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgaccccccagcaggtggtggccatcgtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17812 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgaccccccagcaggtggtggccatcgtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17813 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgaccccccagcaggtggtggccatcgtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 17814 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgaccccccagcaggtggtggccatcgtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17815 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgaccccccagcaggtggtggccatcgtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17816 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17817 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17818 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17819 - DNA, 311 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 17820 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17821 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17822 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17823 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattcaactgatccataaacacctttcactgtcaaaattcatcttcatcctcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17824 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattcaactgatccataaacacctttcactgtcaaaattcatcttcatcctcactaaagctggacctggtgctcaaatttcacctattgaaattgcttctcagctaccaacaactagccctgatgcaccagttatgttggaccgaatgttgcgtctcttggcttgttacaatatcctcacttgtgcagttcgtactcaacaagatggaaaggttcagagactttatggtttggctactgttgctaa

SEQ ID NO: 17825 - DNA, 467 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattacgtttctttttaggatcgcccatgactagcaggtcagggcgagatccggtgcagattatttggattgagagtgaatatgagacgctaattggataccgagggtaaagctggacctggtgctcaaatttcacctattgaaattgcttctcagctaccaacaactaaccctgatgcaccagttatgttggaccgaatgttgcgtctcttggcttggtacaatatcctcacttgttcagttcgtactcaacaagatggaaaggttcagagactttatggtttggctactgttgctaa

SEQ ID NO: 17826 - DNA, 467 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattacgtttctttttaggatcgcccatgactagcaggtaagggcgagatccggtgcagattatttggattgagagtgaatatgagactctaattggataccgagggtaaagctggacctggtgctcaaatttcacctattgaaattgcttctcagctaccaacaactaaccctgatgcaccagttatgttggaccgaatgttgcgtctcttggcttgttactatatcctcacttgttcagttcgtactcaacaagatggaaagattcagagactttatggtttggctactgttgctaa

SEQ ID NO: 17827 - DNA, 467 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattacgtttctttttaggatcgcccatgactagcaggtaagggcgagatccggtgcagattatttggattgagagtgaatatgagactctaattggataccgagggtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17828 - DNA, 467 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattacgtttctttttaggatcgcccatgactagcaggtaagggcgagatccggtgcagattatttggattgagagtgaatatgagactctaattggataccgagggtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17829 - DNA, 467 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattacgtttctttttaggatcgcccatgactagcaggtaagggcgagatccggtgcagattatttggattgagagtgaatatgagactctaattggataccgagggtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17830 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctgttgctcaaatttcacctattgaaattgcttctcagctaccaacaactagccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17831 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcatctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17832 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17833 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17834 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17835 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17836 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcatttcgtactcaacaagatggaaaggttcagagactttatggtttggctactgttgctaa

SEQ ID NO: 17837 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17838 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacacaacaagatggaaaggttcagagactttatggtttggctactgttgctaa

SEQ ID NO: 17839 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 17840 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 17841 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17842 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17843 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17844 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17845 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17846 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17847 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttaagttcgtactcaacaagatggaaaggttcagagactttatggtttggctactgttgctaa

SEQ ID NO: 17848 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaataacctcacttgttcagttcgtactcaacaagatggaaaggttcagagactttatggtttggctactgttgctaa

SEQ ID NO: 17849 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 17850 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17851 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 17852 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttttggctactgttgctaa

SEQ ID NO: 17853 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 17854 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacttaacaagatggaaaggttcagagactttatggtttggctactgttgctaa

SEQ ID NO: 17855 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcttactcaacaagatggaaaggttcagagactttatggtttggctactgttgctaa

SEQ ID NO: 17856 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacgagatggaaaagttcagagactttatggtttggctactgttgctaa

SEQ ID NO: 17857 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatccacttgttcagttcgtactcaacaagatggaaagattcagagactttatggtttggctactgttgctaa

SEQ ID NO: 17858 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17859 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17860 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 17861 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17862 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgattctcagctaccaacaactaaccctgatgcaccagttatgttggaccgaatgttgcgtctctttgcttgttacaatatcctcacttgttcagttcgtactcaacaagatggaaaggttcagagactttatggtttggctactgttgctaa

SEQ ID NO: 17863 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattacttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17864 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctatggaaattgcttctcagctcccaacaactaaccctgatgcaccagttatgttggaccgaatgttgcgtctcttggcttgttacaatatcctcacttgttcagttcgtactcaacaagatggaaaagttcagagtctttatggtttggctactgttgctaa

SEQ ID NO: 17865 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggccatcgctagcaatggcggcggcaggccggcgctggagagcattgttgcccattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17866 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggccatcgccagcaatggcggcggcaggccggcgctggagagcattgttgcccagtaaagctggacctggtgctcaaatttcgcctattgaaattgcttctcagctcccaacaactaaccctgatgcaccagttatgttggaccgaatgttgcgtctcttggcttgttacaatatcctcactttttcagttcttactcaacaagatggaaagattcagagactttatggtttggctactgttgctaa

SEQ ID NO: 17867 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggccatcgccagcaatggcggcggcaggccggcgctggagagcattgttgcccagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17868 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggccatcgccagcaatggcggcggcaggccggcgctggagagcattgttgcccagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17869 - DNA, 441 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggataacgccacggaatgatgtcgtcgtgcacaacaattgtgacttctacagcgccgagaatctcgctctctccaggctacagctggacctggtgctcaaatttcacctattgaaattgcttctcagctcccaacaactatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17870 - DNA, 441 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggataacgccacggaatgatgtcgtcgtgcacaacaatggtgacttctacagcgcggagaatctcgctctctccaggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17871 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 17872 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 17873 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17874 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17875 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17876 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17877 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 17878 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17879 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17880 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggacctggtgctcaaatttcacctattgaaattgcctctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17881 - DNA, 398 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctggagacggtccagcggctgttgccggtgctgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactgtatggtttggctactgttgctaa

SEQ ID NO: 17882 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctggaccttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17883 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17884 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17885 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17886 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17887 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17888 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17889 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactgtatggtttggctactgttgctaa

SEQ ID NO: 17890 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctggacctggtgcacaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17891 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17892 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctaatgttgctaa

SEQ ID NO: 17893 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17894 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17895 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctaaagctggacctggtgctcaaatttcacctattgaaattgcttctcagctcccaacaactaaccctgatgcaccagttatgttggactgaatgttgcgtctcttggcttgttacaatatcctcacttgttcagttcgtactcaacaagatggaaagattcagagactttatggtttggctactgttgctaa

SEQ ID NO: 17896 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17897 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgacaagattcagagactttatggtttggctactgttgctaa

SEQ ID NO: 17898 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17899 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagctcagagactttatggtttggctactgttgctaa

SEQ ID NO: 17900 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17901 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatgcccatcgccagcaatggcgccggcaggtcgtcgctggagagcattgttgcccagtaaagctggacctggtgctcaaatttcacctattgaaattgcttctcagctcccaacagctaaccctgatgcaccagttatgttggaccgaatgttgcgtctcttggcttgttacaatatcctcacttgttcagttcgtactcaacaagatggaaaggttcagagactgtatggttaggctactgttgctaa

SEQ ID NO: 17902 - DNA, 322 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17903 - DNA, 322 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17904 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaattttacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17905 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctgttcaaattgcttctcagcttccaacaactaaccctgatgcactagtcatgttggaccgaatgttgcgtctcttggcttgttacaatatcctcacttgttcagttcgtactcaacaagatggaaaggttcagagactttatggtttggctactgttgctaa

SEQ ID NO: 17906 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17907 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaagttgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17908 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17909 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcagctcccgacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17910 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17911 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17912 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 17913 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 17914 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcagctaccaactactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17915 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17916 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17917 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaac

SEQ ID NO: 17918 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17919 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 17920 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaagttcagagactttatggtttggctactgttgctaa

SEQ ID NO: 17921 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 17922 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 17923 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 17924 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17925 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17926 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17927 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatcgttgcgttaagccaacacccggcagcgtttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17928 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatcgttgcgttaagccaacacccggcagcgtttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17929 - DNA, 387 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatccagcgccggcctgccgccgccattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17930 - DNA, 366 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17931 - DNA, 366 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17932 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatcagcgccggcctgccgccgccattgctggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17933 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 17934 - DNA, 395 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatatctgctgcttgcatccaataaaaacacctcttacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17935 - DNA, 395 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatatctgctgcttgcaaacaaaaaaaccaccgctaccagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17936 - DNA, 395 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatatctgctgcttgcaaacaaaaaaaccaccgctaccagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17937 - DNA, 394 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatatctgctgcttgcaaacaaaaaaaccaccgctaccagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctctgttgctaa

SEQ ID NO: 17938 - DNA, 395 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatatctgctgcttgcaaacaaaaaaaccaccgctaccagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17939 - DNA, 440 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataggatcccccaatccctttttcactgcatccagcgcaggacgcccgccgaggcaggccaaggcgacgaggtggttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17940 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17941 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatactgggcctttcgttttatctgttgtttgtcggtgaacgctctcctgagtaggacctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17942 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatactgggcctttcgttttatctgttgtttgtcggtgaacgctctcctgagtaggacctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17943 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatactgggcctttcgttttatctgttgtttgtcggtgaacgctctcctgagtaggacctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17944 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatactgggcctttcgttttatctgttgtttgtcggtgaacgctctcctgagtaggacctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17945 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagaccttatggtttggctactgttgctaa

SEQ ID NO: 17946 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17947 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17948 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17949 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17950 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagtctttatggtttggcgactgttgctaa

SEQ ID NO: 17951 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17952 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaagattcagagactttatggtttggctactgttgctaa

SEQ ID NO: 17953 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctcccaacaactaaccctgatgcaccagttatgttggaccgaatgttgcgtcccttggcttgttacaatatcctcacttgttcagttcgtactcaacaagatggaaaggttcagagactttatggtttggctactgttgctaa

SEQ ID NO: 17954 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctcccaacaactaaccctgatgcaccagttatcttgtacctaattttgcgtctcttggcttgttacaatatcctcacttgttcagttcgtactcaacaagatggaaaggttcagagactttatggtttcgctactgttgctaa

SEQ ID NO: 17955 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17956 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggcgactgttgctaa

SEQ ID NO: 17957 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17958 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 17959 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagatactttatggtttggctactgttgctaa

SEQ ID NO: 17960 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17961 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctctaggcttgttacaatatcctcacttgttcagttcgtactcaacaagatggaaaggttcagagactttatggtttggctactgttgctaa

SEQ ID NO: 17962 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgcaa

SEQ ID NO: 17963 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctaccgttgctaa

SEQ ID NO: 17964 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 17965 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgctcagttcgtactcaacaagatggaaaagttcagagactttatggtttggctactgttgctaa

SEQ ID NO: 17966 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttattcagttcgtactcaacaagatggaaagattcagagactttatggtttggctactgttgctaa

SEQ ID NO: 17967 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaggatggaaaggttcagagactttatggtttggctactgttgctaa

SEQ ID NO: 17968 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 17969 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17970 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctgttcgaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgcta

SEQ ID NO: 17971 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17972 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctgttcaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17973 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17974 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17975 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 17976 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17977 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaatatggaaagattcagagactttatggtttggctactgttgctaa

SEQ ID NO: 17978 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17979 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 17980 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17981 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17982 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17983 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 17984 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17985 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17986 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 17987 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgtggcgaa

SEQ ID NO: 17988 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 17989 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgcaa

SEQ ID NO: 17990 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 17991 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 17992 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 17993 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgtctactgttgctaa

SEQ ID NO: 17994 - DNA, 458 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagtccagcggctgtttccggtgctgtgccaggcccacggcttgaccccggagcaggtggtggccatcgccagcaatgatggcggcaagcaggcgctggacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17995 - DNA, 458 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagtccagcggctgttgccggtgctgtgccaggcccacggcttgaccccggagcaggtggtggccatcgccagccatgatggcggcaagcaggcgctggacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 17996 - DNA, 458 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagtccagcggctgttgccggtgctgtgccaggcccacggcttgaccccggagcaggtggtggccatcgccagccacgatggcggcaagcaggcgctggacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17997 - DNA, 458 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagtccagcggctgttgccggtgctgtgccaggcccacggcttgaccccggagcaggtggtggccatcgccagcaatgatggcggcaagcaggcgctggacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17998 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 17999 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcaaagactttatggtttggctactgttgctaa

SEQ ID NO: 18000 - DNA, 466 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaggcgctggagacggtgcaggcgctgttgccggtgctgtgccaggcccacggcttgaccccggagcaggtggtggccatcgccagcaatattggtggcaagcaggcgctggacgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18001 - DNA, 466 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaggcgctggagacggtgcaggcgctgttgccggtgctgtgccaggcccacggcttgaccccggagcaggtggtggccatcgccagcaatattggtggcaagcaggcgctggacgacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18002 - DNA, 458 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaggcccacggcttgaccccggagccggtggtggccatccccagccacgatggcggcaagcaggcgctggagacggtccagcggctgttgccggtgcctaaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18003 - DNA, 458 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaggcccacggcttgaccccggagcaggtggtggccatcgccagccacgatggcggcaagcaggcgctggagacggtccagcggctgttgccggtgcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18004 - DNA, 458 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaggcccacggcttgaccccggagcaggtggtggccatcgccagccacgatggcggcaagcaggcgctggagacggtccagcggctgttgccggtgcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18005 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagcttgacctggtgctcaaatttcacctattgaaattgcttctcagctaccaacaactaaccctgatgcaccagttatgttggaccgaatgttgcgtctcttggcttgttacaatttcctcacttgttcagttcgtactcaacaagatggaaagattcagagactttattgtttggctactgttgctaa

SEQ ID NO: 18006 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggaccttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18007 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18008 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18009 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 18010 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18011 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctcccaacaactaaccctgatgcactagttatgttggaccgaatgttgcgtctcttggcttgttacaatatcctcacttgttcagttcgtactcaacaagatggaaagattcagagactttatggtttggctactgttgctaa

SEQ ID NO: 18012 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18013 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18014 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgtccagttcgtactcaacaagatggaaagattcagagactttatggtttggctactgttgctaa

SEQ ID NO: 18015 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctga

SEQ ID NO: 18016 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctcccaacaactaaccctgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 18017 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctattgttgctaa

SEQ ID NO: 18018 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18019 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18020 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgtttctaa

SEQ ID NO: 18021 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 18022 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18023 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18024 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatttggcgtctcttggcttgttacaatatcctcacttgttcagttcgtactcaacaagatggaaagattcagagactttatggtttggctactgttgctaa

SEQ ID NO: 18025 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgagtgttgcgtctcttgggttgttacaatatcctcacttgttcagttcgtactcaacaagatggaaagattcagagactttatggtttggctactgttgctaa

SEQ ID NO: 18026 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcttgctaa

SEQ ID NO: 18027 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgatcagttcgtactcaacaagatggaaaggttcagagactttatggtttggctactgttgctaa

SEQ ID NO: 18028 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 18029 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagttacgttggaccgaatgttgcgtctcttggcttgttacaatatcctcacttgttcagttcgtactcaacaagatggaaaagttcagagactttatggtttggctactgttgctaa

SEQ ID NO: 18030 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18031 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18032 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18033 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctactgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18034 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacccattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18035 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggcgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18036 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggaccaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18037 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18038 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18039 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18040 - DNA, 395 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagcgccggcctgccgccgccattgctggcgatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18041 - DNA, 475 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagccgctggaccgtctccagcgcctgcttgccaccgccattgctggcgatggccaccacctgctggggggtcaagccgtgggcctggcacagcaccggaaacagccgctggagctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18042 - DNA, 424 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagcaggtgttggccatcgccagcaatattggtgccaagcaggcgctggagacggtgcaggcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18043 - DNA, 424 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagcaggtgttggccatcgccagcaatattggtgccaagcaggcgctggagacggtgcaggcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18044 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagcaatggcggcggcaggccggcgctggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18045 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18046 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18047 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18048 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18049 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18050 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18051 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagacctggtgctcaaatttcaactattgaaattgcttctcagctaccaacaactaaccatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18052 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggggggtcaagccgtgggcctggcacagcaccggcaacagccgctggaccgtctccagcgcctgcagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18053 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggggggtcaagccgtgggcctggcacagcaccggcaacagccgctggaccgtctccagcgcctgaagctggccatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18054 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctgtgctcaaatttcacctatttaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18055 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgcttaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18056 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18057 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctatttaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18058 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18059 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18060 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgtgacaatatcctcgcttgttcagttcgtactcaacaagatggaaaggttcagagactttatggtttggctactgttgctaa

SEQ ID NO: 18061 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaataccctcacttgttcagttcgtactcaacaagatggaaaggttcagagactttatggtttggctactgttgctaa

SEQ ID NO: 18062 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18063 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18064 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagattttatggtttggctactgttgctaa

SEQ ID NO: 18065 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18066 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18067 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacactatcctcacttgttcagttcgtactcaacaagatggaaaggttcagagactttatggtttggctactgttgctaa

SEQ ID NO: 18068 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaacatcctcacttgttcagttcgtactcaacaagatggaaaagttcagagactttatggtttggctactgttgctaa

SEQ ID NO: 18069 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 18070 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 18071 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatccgcacttgttcagttcgtactcaacaagatggaaaggttcagagactttatggtttggctactgttgctaa

SEQ ID NO: 18072 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 18073 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18074 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcctctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18075 - DNA, 462 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactccgggccgttgcttcacaacgttcaaatccgctcccggcggatttgtcctactcaggagagcgttcaccgacaaacaacagataaaacgaaaggcccagtcagctggacctggtgctcaaatttcacctattgaaattgcttctcagctaccaacaacgaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 18076 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactacagctgagcctgatgctcaaattacacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18077 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagcttgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18078 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18079 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 18080 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtacccaacaagatggaaaggttcagagactttatggtttggctactgttgtaa

SEQ ID NO: 18081 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggagaggttcagagactttatggtttggctactgttgctaa

SEQ ID NO: 18082 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18083 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctcccaacaactaaccctgatgcaccagttatgttggaccgaatgttgcgcctcttggcttgttacaatatcctcacttgttcagttcgtactcaacaagatggaaaggttcagagactttatggtttggctactgttgctaa

SEQ ID NO: 18084 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18085 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18086 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 18087 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18088 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18089 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 18090 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18091 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18092 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaattttgcgtctcttggcttgttacaatatcctcacttgttcagttcgtactcaacaagatggaaaggttcagagactttatggtttggctactgttgctaa

SEQ ID NO: 18093 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagtctttatggtttggctactgttgctaa

SEQ ID NO: 18094 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctctgttgctaa

SEQ ID NO: 18095 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcctgttacaatatcctcacttgttcagttcgtactcaacaagatggaaaggttcagagactttatggtttggctactgttgctaa

SEQ ID NO: 18096 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgggaaagttcagagactttatggtttggctactgttgctaa

SEQ ID NO: 18097 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagatactttatggtttggctactgttgctaa

SEQ ID NO: 18098 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 18099 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 18100 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 18101 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttacgttggaccgaatgttgcgtctcttggcttgttacaatatcctcacttgttctgttcgtactcaacaagatggaaaggttcagagactttatggttgggctactgttgctca

SEQ ID NO: 18102 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagatatgttggaccgaatgttgcgtctcttggcttgttacaatatcctcacttgttcagttcgtactcaacaagatggaaaggttcagagactttatggtttggctactgttgctaa

SEQ ID NO: 18103 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcacggtccagcggctgttgccggtgctgtgccaggcccacggcttgaccccccagcaggtggtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18104 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcacggtccagcggctgttgccggtgctgtgccaggcccacggcttgaccccccagcaggtggtaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18105 - DNA, 456 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcacggcttgaccccggagcaggtggtggccatcgccagcaatattggtggcaagcaggcgctggagacggtcccgcggctgttgccggtgctgtgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18106 - DNA, 456 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcacggcttgaccccggagcaggtggtggccatcgccagcaatattggtggcaagcaggcgctggagacggtccagcggctgttgccggtgctgtgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18107 - DNA, 456 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcacggcttgaccccggagcaggtggtggccatcgccagcaatattggtggcaagcaggcgctggagacggtccagcggctgttgccggtgctgtgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18108 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18109 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18110 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18111 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18112 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18113 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18114 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18115 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18116 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18117 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18118 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18119 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 18120 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagcttgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18121 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggaccttgtgctcaaatttcacctattgaaattgcttctcagctcccaacaactaaccctgatgcaccagttatgttggaccgaatgttgcgtctcttggcttgttacaatatcctcacttgttcagttcgtacttaacaagatggaaagattcagagactttatggtttggctactgttgctaa

SEQ ID NO: 18122 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctgttgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18123 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgcttaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18124 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcatatttcacctattgaaattgcttctcagctaccaacaactaaccctgatgcaccagttatgttggaccgaatgttgcgtctcttggcttgttacaatatcctcatttgttcagttcgtactcaacaagatggaaaggttcagagactttatggtttggctactgttgctaa

SEQ ID NO: 18125 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttctcctattgaaattgcttctcagctaccaacaactaaccctgattcaccagttatgttgtaccgaatgttgcgtctcttggcttgttacaatatcctcacttgttcagttcgtactcaacaagatggaaaagttcagagactttatggtttgtctactgttgctaa

SEQ ID NO: 18126 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttctcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18127 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcaccttttgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18128 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctgttcaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18129 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18130 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18131 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18132 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18133 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagcctttatggtttggctactgttgctaa

SEQ ID NO: 18134 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18135 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18136 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcttaa

SEQ ID NO: 18137 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18138 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18139 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattggaattgcttctcagctaccaacaactaaccctgatgaaccagttatgttggaccgaatgttgcgtctcttggcttgttacaatatcctcacttgttcagttcgtactcaacaagatggaaagattcagagactttatggtttggctactgttgctaa

SEQ ID NO: 18140 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18141 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18142 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttcttagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18143 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18144 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18145 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctgccaacaactaaccctgatgcaccagttatgttggaccgaatgttgcggctcttggcttgttacaatatcctcacttgttcagttcgtactcaacaagatggaaaggttcagagactttatggtttggctactgttgctaa

SEQ ID NO: 18146 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgctccagttatgttggaccgaatgttgcgtctcttggcttgttacaatatcctcacttgttcagttcgtactcaacaagatggaaagattcagagactttatggtttggctactgttgctaa

SEQ ID NO: 18147 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18148 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18149 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18150 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18151 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactctatggtttggctactgttgctaa

SEQ ID NO: 18152 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggacagaatgttgcgtctcttggcttgttacaatatcctcacttgttcagttcgtactcaacaagatggaaagattcagagactttatggtttggctactgttgctaa

SEQ ID NO: 18153 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 18154 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagatccagagactttatggtttggctactgttgctaa

SEQ ID NO: 18155 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctacctgttgctaa

SEQ ID NO: 18156 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcactttttcagttcgtactcaacaagatggaaagattcagagactttatggttttgctactgttgctaa

SEQ ID NO: 18157 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcttaa

SEQ ID NO: 18158 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggattgttacaatatcctcacttgttcagttcgtactcaacaagatggaaagattcagagactttatggtttggctactgttgctaa

SEQ ID NO: 18159 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtcctcaacatgatgtaaagattagaagcctttatgatttggctacttttactaa

SEQ ID NO: 18160 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagaaggaaaggttcagagactttatggtttggctactgttgctaa

SEQ ID NO: 18161 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggacagaatgttgcgtctcttggcttgttacaatatcctcacttgttcagttcgtactcaacaagatggaaaggttcagagcctttatggtttggctactgttgctaa

SEQ ID NO: 18162 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgttaa

SEQ ID NO: 18163 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 18164 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18165 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaacccttatgcaccagttatgttggaccgaatgttgcgtctcttggcttgttacaatatcctcacttgttcagttcgtactcaacaagatggaaagattcagagactttatggtttggctactgttgctaa

SEQ ID NO: 18166 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 18167 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18168 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18169 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 18170 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18171 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtcacttggcttgttacaatatcctcacttgttcagttcgtactcaacaagatggaaaggttcagagactttatggtttggctactgttgctaa

SEQ ID NO: 18172 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggctagttacaatatcctcacttgttcagttcgtactcaacaagatggaaaagttcagagactttatggtttggctactgttgctaa

SEQ ID NO: 18173 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 18174 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtagctaa

SEQ ID NO: 18175 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 18176 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttgctactgttgctaa

SEQ ID NO: 18177 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgagtgttgcgtctcttggcttgttacaatatcctcacttgttcagttcgtactcaacaagatggaaagattcagagactttatggtttggctactgttgctaa

SEQ ID NO: 18178 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgtgctaa

SEQ ID NO: 18179 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 18180 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 18181 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctag

SEQ ID NO: 18182 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaagatggaaaggttcagagactttatggtttggctactgttgctaa

SEQ ID NO: 18183 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctctgttgctaa

SEQ ID NO: 18184 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttgggttgttacaatatcctcacttgttcagttcgtactcaacaagatggaaaggttcagagactttatggtttggctactgttgctaa

SEQ ID NO: 18185 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgggaaggttcagagactttatggtttggctactgtgctaa

SEQ ID NO: 18186 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaagttcagagactttatggtttggctactgttgctaa

SEQ ID NO: 18187 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttg

SEQ ID NO: 18188 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 18189 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 18190 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatgttttggctactgttgctaa

SEQ ID NO: 18191 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 18192 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttttggtttggctactgttgctaa

SEQ ID NO: 18193 - DNA, 359 bp, Artificial
  MsCOMT deletion introduced by TALEN pair MsCOMT_T02.1
  misc_feature (359): n is a or c or t or g
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctan

SEQ ID NO: 18194 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 18195 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactatatggtttggctactgttgctaa

SEQ ID NO: 18196 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgaaaaggttcagagactttatggtttggctactgttgctaa

SEQ ID NO: 18197 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18198 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatgtcctcacttgttcagttcgtactcaacaagatggaaaggttcagagcctttatggtttggctactgttgctaa

SEQ ID NO: 18199 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgttctcaacaagatggaaagattcagagactttatggtttggctactgttgctaa

SEQ ID NO: 18200 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18201 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18202 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18203 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18204 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatctcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18205 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18206 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtcctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctacggttgcaaa

SEQ ID NO: 18207 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtactcaaatttcacctgttcaaattgcttctcagcttccgacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18208 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtactcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18209 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtactcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 18210 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctgctgctcaaatttctcctattgaaattgcttctcagataccaacatctaacactgatgcaccagttatgttggaaagaatgtagagtatcatggcctggaacaatatcctcacttgttcagttcgttcacatccagatggaaaagctcagagacttaatgggttggctagtggtggtaa

SEQ ID NO: 18211 - DNA, 391 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagcgccggcctgccgccgccattgctggctaaagctggacctggtgctcaaatttcacctattgaaattgcttctcagctgccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18212 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagccgtgggcctggcacagcaccggcaactgccgctggaccgtctccagcgcctgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18213 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagccgtgggcctggcacagcaccggcaacagccgctggaccgtctccagcgcctgctaaagctggacctggtgctcaaatttcgcctgttcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 18214 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagccgtgggcctggcacagcaccggcaacagccgctggaccgtctccagcgcctgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18215 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagccgtgggcctggcacagcaccggcaacagccgctggaccgtctccagcgcctgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18216 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagccgtgggcctggcacagcaccggcaacagccgctggaccgtctccagcgcctgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18217 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagccgtgggcctggcacagcaccggcaacagccgctggaccgtctccagcgcctgctaaagctggacctggtgctcaaatttcacctattgaaattacttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18218 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagccgtgggcctggcacagcaccggcaacagccgctggaccgtctccagcgcctgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18219 - DNA, 417 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagccgtgggcctggcacagcaccggcaacagccgctggaccgtctccagcgcctgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 18220 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagccgtgggccgggcacagcaccggcaccagaccttgtaccgtctccagcccttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18221 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaacgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18222 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcagcaagatggaaaagttcagagactttatggtttggctactgttgctaa

SEQ ID NO: 18223 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18224 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18225 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18226 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18227 - DNA, 385 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaacagataaaacgaaaggctcagctgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18228 - DNA, 385 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaacagataaaacgaaaggctcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18229 - DNA, 385 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaacagataaaacgaaaggctcagctaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 18230 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctgtacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18231 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctgttgctcaaatttcacctattgaaattgcttctcagcttccaacaactaaccctaatgcaccagttatgttggaccgaatgttgcgtctcttggcttgttacaatatcctcacttgttcagttcgtactcaacaagatggaaagattcagagactttatggtttggctcctgttgctaa

SEQ ID NO: 18232 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgttcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18233 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18234 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18235 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18236 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18237 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18238 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctgttcaaattgcttcgcagcttccaacaactaaccctgatgcaccagttatgttggaccgaatgttgcgtctcttggcttgttacaatatcctcacttgttcagttcgtactcaacaagatggaaaggttcagagactttatggtttggctactgttactaa

SEQ ID NO: 18239 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgtaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18240 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18241 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18242 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18243 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18244 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatccgcacttgttcagttcgtactcaacaagacggaaagattcagagactgtatggtttggctactgttgctaa

SEQ ID NO: 18245 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18246 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctctttgcttgttacaatatcctcacttgttcagttcgtactcaacaagatggaaagattcagagactttatggtttggctactgttgctaa

SEQ ID NO: 18247 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18248 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgaaaagattcagagactttatggtttggctactgttgctaa

SEQ ID NO: 18249 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 18250 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 18251 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 18252 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttgtggtttggctactgttgctaa

SEQ ID NO: 18253 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctctgttgctaa

SEQ ID NO: 18254 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttgcaccgaatttttcgtcacttggcttggtacaattgcctcaatttttcagttcgtactcaactagatggaaagtttcagagactatgtggtttggcaactgttgataa

SEQ ID NO: 18255 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 18256 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18257 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18258 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18259 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttgctactgttgctaa

SEQ ID NO: 18260 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatggaccagttatgttggaccgaatgttgcgtctcttggcttgttacaatatcctcacttgttcagttcgtactcaacaagatggaaaggttcagagactttatggtttggctactgttgctaa

SEQ ID NO: 18261 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttgggccgaatgttgcgtctcttggcttgttacaatatcctcacttgttcagttcgtactcaacaagatggaaagattcagagactttatggtttggctactgttgctaa

SEQ ID NO: 18262 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcgtgttacaatatcctcacttgttcagttcgtactcaacaagatggaaaggttcagagactttatggtttggctactgttgctaa

SEQ ID NO: 18263 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18264 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18265 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18266 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgtatgttgcgtctcttggcttgttacaatatcctcacttgttcagttcgtactcaacaagatggaaaggttcagagactttatggtttggctactgttgctaa

SEQ ID NO: 18267 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcccttgttcagttcttactcaacaagattgaaaggttcagagactttatggtttggctactgttgctaa

SEQ ID NO: 18268 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18269 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatagcctcacttgttcagttcgtactcaacaagatggaaaggttcagagactttatggtttggctactggtgctaa

SEQ ID NO: 18270 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 18271 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcgcttgttcagttcttactcaacaagatggaaaggttcagagtctttatggtttggctactgttactaa

SEQ ID NO: 18272 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtattcaacaagatggaaaggttcagagactttatggtttggctactgttgctaa

SEQ ID NO: 18273 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatcgtttggctactgttgctaa

SEQ ID NO: 18274 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgggtctcttggcttgttacaatatcctcacttgttcagttcgtactcaacaagatggaaaggttcagagactttatggtttggctactgttgctaa

SEQ ID NO: 18275 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttgtctactgttgctaa

SEQ ID NO: 18276 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtcgcttggcttgttacaatatcctcagttgttcagttcgtactcaacaagatggaaaggttcagagcctttatggtttggatactgttgctaa

SEQ ID NO: 18277 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggagagattcagagactttatggtttggctactgttgctaa

SEQ ID NO: 18278 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgtaaaggttcagagactttatggtttggctactgttgctaa

SEQ ID NO: 18279 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 18280 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacgagatggaaaggttcagagactttatggtttggctactgttgctaa

SEQ ID NO: 18281 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacttgttgctaa

SEQ ID NO: 18282 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 18283 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 18284 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagtccgtactcaacaagatggaaaagttcagagactttatggtttggctactgttgctaa

SEQ ID NO: 18285 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtagctaa

SEQ ID NO: 18286 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 18287 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaattttgcgtctcttggcttgttacaatatcctcacttgttcagttcgtactcaacaagatggaaaggttcagagactttatggtttggctactgttgctaa

SEQ ID NO: 18288 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 18289 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaataacctcacttgttcagttcgtactcaacaagatggaaaggttcagagactttatggtttggctactgttgctaa

SEQ ID NO: 18290 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttggtaa

SEQ ID NO: 18291 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttgaaccgaatgttgcgtctcttggcttgttacaatatcctcacttgttcagttcgtactcaacaagatggaaaggttcagagactttatggtttggctactgttgctaa

SEQ ID NO: 18292 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18293 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18294 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaattgcacctattgaaattgcttctcagctcccaacaactaaccctgatggaccagttatgtgggaccgaatgttgcgtcgcttggcttgttacaatagcctcacgtgttcagttcgtactcaacaagatggaaagattcagagaatttatggtttggctactggtgctaa

SEQ ID NO: 18295 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctcgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18296 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggaccttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18297 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcatatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18298 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcgcctattgaaattgcttctcagccaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18299 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18300 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18301 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctgttcaaattgcttctcagcttccaacaactaaccctgatgcaccagtcatgttggaccgaatgttgcgtctcttggcttgttacaatatcctcactcgttcagttcgtactcaacaagatggaaaggttcagagactttatggtttggctactgttgctaa

SEQ ID NO: 18302 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18303 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18304 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 18305 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18306 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18307 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtaatcaacaagatggaaaggttcagagactttatggtttgctactgttgctaa

SEQ ID NO: 18308 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 18309 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18310 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 18311 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctactaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18312 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctaccaccaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18313 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18314 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18315 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18316 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggttggctactgttgctaa

SEQ ID NO: 18317 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgtgcagttcgtactcaacaagatggaaaggttcagagactttatggtttggctactgttgcaa

SEQ ID NO: 18318 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18319 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18320 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18321 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattacgtctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18322 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaagtgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18323 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18324 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18325 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18326 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18327 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18328 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18329 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18330 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatagaaaggttcagagactttatggtttggctactgttgctaa

SEQ ID NO: 18331 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatatggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18332 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 18333 - DNA, 469 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatatattgctggcgatggccaccacctgctccggggtcaagccgtgggcctggcacagcaccggcaacagccgctggaccgtctccagcgcctgcttgccaccattattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18334 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatatacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18335 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18336 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataacgctggacctggtgctcaaatttcacctattgaaattgcttctcagctcccaacaactaaccctgatgcaccagttatgttggaccgaatgttgcgtctcttggcttgttacaatatcctcacttgtgcagttcgtactcaacaagatggaaagattcagagactttatggtttggctactgttgctaa

SEQ ID NO: 18337 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctgttactcaaatttcacctattgaaattgcttctcagctaccaacaactaaccctgatgcaccagttatgttggaccgaatgttgcgtctcttggcttgttacaatatcctcacttgttcagttcgtactcaacaagattgaaaggttcagagactttattgtttggctactgttgctaa

SEQ ID NO: 18338 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgttcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18339 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18340 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18341 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18342 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 18343 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttaagttcgtactcaacaagatggaaagattcagagactttatggtttggctactgttctaa

SEQ ID NO: 18344 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18345 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18346 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18347 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18348 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18349 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatccccacttgttcagttcgtactcaacaagatggaaaggttcagagactttatggtttggctactgttgctaa

SEQ ID NO: 18350 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18351 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatccgcacttgttcagttcgtactcaacaagatggaaaggttcagagactttatggtttggctactgttgctaa

SEQ ID NO: 18352 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagacttatggtttggctactgttgctaa

SEQ ID NO: 18353 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctacaaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18354 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18355 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18356 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18357 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18358 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18359 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18360 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18361 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcgaa

SEQ ID NO: 18362 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctcccaacaactaaccctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 18363 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtacttaacaagatggaaaagttcagagactttatggtttggctactgttgctaa

SEQ ID NO: 18364 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 18365 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaggattcagagactttatggtttggctactgttgctaa

SEQ ID NO: 18366 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtaa

SEQ ID NO: 18367 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacgactaaccctgatgcaccagttatgttgggccgaatgttgcgtctcttggcttgttacaatatcctcacttgttcagttcgtactcaacaagatggaaaagttcagagactttatggtttggctactgttgctaa

SEQ ID NO: 18368 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18369 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcatttcgtactcaacaagatggaaaagttcagagactttatggtttggctactgttgctaa

SEQ ID NO: 18370 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 18371 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18372 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18373 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgttctcaacaagatggaaagattcagagactttatggtttggctactgttgctaa

SEQ ID NO: 18374 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18375 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggcactgttgctaa

SEQ ID NO: 18376 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagaccttatggtttggctactgttgctaa

SEQ ID NO: 18377 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 18378 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcctgttacaatatcctcacttgttcagttcgtactcaacaagatggaaagattcagagactttatggtttggctactgttgctaa

SEQ ID NO: 18379 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacgagatggaaaggttcagagactttatggtttggctactgttgctaa

SEQ ID NO: 18380 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcctaa

SEQ ID NO: 18381 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18382 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18383 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18384 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18385 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 18386 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18387 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataccacctgctccggggtcaagccgtgggcctggcacagcaccggcaacagccgctggaccgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18388 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataccacctgctccggggtcaagccgtgggcctggcacagcaccggcaacagccgctggaccgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18389 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataccacctgctccggggtcaagccgtgggcctggcacagcaccggcaacagccgctggaccgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18390 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataccacctgctccggggtcaagccgtgggcctggcacagcaccggcaacagccgctggaccgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18391 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatacagtatcctcacttgttcagttcgtactcaacaagatggaaagattcagagactttatggtttggctactgttgctaa

SEQ ID NO: 18392 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatacaatatcctcacttgtttagttcgtactcaacaagatggaaaagttcagagactttatggtttggctactgttgctaa

SEQ ID NO: 18393 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatacaatatcctcacttgttcagttcgtactcaacaagatggaaaggttcagagactttatggtttggctactgttgctaa

SEQ ID NO: 18394 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatacaatatcctcacttgttcagttcgtactcaacaagatggaaagattcagagactttatggtttggctactgttgctaa

SEQ ID NO: 18395 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatacaatatcctcacttgttcagttcgtactcaacaagatggaaaagttcatagactttatggtttggctactgttgctaa

SEQ ID NO: 18396 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatacaatatcctcacttgttcagttcgtactcaacaagatggaaaagttcagagactttatggtttggctactgttgctaa

SEQ ID NO: 18397 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatacaatatcctcacttgttcagttcgtactcaacaacatggaaaagttcagagactttatggtttggctactgttgctaa

SEQ ID NO: 18398 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18399 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctgtacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18400 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacttggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18401 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctgttgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18402 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgttcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18403 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18404 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18405 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18406 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18407 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctac

SEQ ID NO: 18408 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18409 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgcgaa

SEQ ID NO: 18410 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccgacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18411 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaattaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18412 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 18413 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 18414 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18415 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcgcttgttcagttcgtactcaacaagatggaaagattccgagactttatggtttggctactgttgctaa

SEQ ID NO: 18416 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18417 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 18418 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaagattcagagactttatggtttggctactgatgaaaa

SEQ ID NO: 18419 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggttactgttgctaa

SEQ ID NO: 18420 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 18421 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18422 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18423 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 18424 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18425 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctggtgcaccagttatgttggaccgaatgttgcgtctcttggcttgttacaatatcctcacttgttcagttcgtactcaacaagatggaaagattcagagactttatggtttggctactgttgctaa

SEQ ID NO: 18426 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaagttcagagactttatggtttggctactgttgctaa

SEQ ID NO: 18427 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaaagttcagagactttatggtttggctactgttgctaa

SEQ ID NO: 18428 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggagcgaatgttgcgtctcttggcttgttacaatatcctcacttgttcagttcgtactcaacaagatggaaaggttcagagactttatggtttggctactgttgctaa

SEQ ID NO: 18429 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18430 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18431 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18432 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 18433 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagaggctttatggtttggctactgttgctaa

SEQ ID NO: 18434 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctctttgcttgttacaatatcctcacttgttcagttcgtactcaacaagatggaaagattcagagactttatggtttggctactgttgctaa

SEQ ID NO: 18435 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgtgtctcttggcttgttacaatatcctcacttgttctgttcgtactcaacaagatggaaaggttcagagactttatggtttggctactgttgctaa

SEQ ID NO: 18436 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 18437 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacattatcctcacttgttcagttcgtactcaacaagatggaaaggttcagagactttatggtttggctactgttgctaa

SEQ ID NO: 18438 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggttgggctactgttgctaa

SEQ ID NO: 18439 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18440 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcgtggcttgttacaatatcctcacttgttcagttcgtactcaacaagatggaaaggttcagagactttatggtttggctactgttgctaa

SEQ ID NO: 18441 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaggttcagagactttatggtttggctactgttgctaa

SEQ ID NO: 18442 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 18443 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttcttacaatatcctcacttgttcagttcgtactcaacaagatggaaaagttcagagactttatggtttggctactgttgctaa

SEQ ID NO: 18444 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 18445 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 18446 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 18447 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcctactcaacaagatggaaaagttcagagactttatggtttggctactgttgctaa

SEQ ID NO: 18448 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18449 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18450 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggaccttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18451 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18452 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18453 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtggtcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18454 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaagtttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18455 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaattttacctattgaaattgctcctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18456 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18457 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18458 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctgttcaaattgcttctcagcttccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 18459 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18460 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18461 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18462 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 18463 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 18464 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctac

SEQ ID NO: 18465 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctgttcaaattgcttctcagcttccaacaactaaccctgatgcaccagtcatgctggaccgaatgttgcgtctcttggcttgttacaatatcctcacttgttcagttcgtactcaacaagatggaaaggttcagagactttatggtttggctactgttgctaa

SEQ ID NO: 18466 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18467 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18468 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattggaattgcttctcagctaccaacaactaaccctgatgcaccagttatgttgtaccgaatgttgcgtctctgggcttgttactatatcctcactagttcagttcgtaatcaacgagatggaaaggttcagagactttatggtttggcgactggtgctaa

SEQ ID NO: 18469 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgagattgcttctcagctaccaacagctaaccctgatgcaccagttatgttggaccgaatgttgcgtctcttggcttgttacaatatcctcacttgttcagttcgtactcaacaagatggaaaggttcagagactttatggtttggctactgtggcgaa

SEQ ID NO: 18470 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgagattgcttctcagctaccaacaactaaccctgatgcaccagttatgttggaccgaatgttgcgtatcttggcttgttacaatgtcctcgctttttcagttcgtactcatcaagatggaaaggttcagagactttatggtttggctactgtatctaa

SEQ ID NO: 18471 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18472 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18473 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18474 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18475 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18476 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18477 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaacccttatgcaccagttatgttgtaccgaatgtttcgtctcttggcttgttacaatatcctcacttgttcatttcgtactcaacaagatggaaaggttcagagcctttatggtttggctactgttgctaa

SEQ ID NO: 18478 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttgtaccgaatgttgcgtctcttggcttgttacaatatcctcacttgttcagttcgtactcaacaagatggaaagattcagagactttatggtttggctactgttgctaa

SEQ ID NO: 18479 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18480 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18481 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18482 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 18483 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 18484 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 18485 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctctgggcttgttacaatatcctcacttgttcagttcgtactcaacaagatggaaaggttcagagactttatggtttggcgacttttgctaa

SEQ ID NO: 18486 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtcctcaacaagatgtaaagattcagagactttatcgtttggctactgttgctaa

SEQ ID NO: 18487 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 18488 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaacgttgcgtctcttggcttgttacaatatcctcacttgttcagttcgtactcaacaagatggaaagattcagagactttatggtttggctactgttgctaa

SEQ ID NO: 18489 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 18490 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 18491 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18492 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 18493 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactttgctaa

SEQ ID NO: 18494 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 18495 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 18496 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacgatatcctcacttgttcagttcgtactcaacaagatggaaagattcagagactttatggtttggctactgttgctaa

SEQ ID NO: 18497 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaaccagatggaaaggttcagagactttatggtttggctactgttgctaa

SEQ ID NO: 18498 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggattgttacaatatcctcacttgttcagttcgtactcaacaagatggaaaggttcagagactttatggtttggctactgttgctaa

SEQ ID NO: 18499 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccggatgttgcgtctcttggcttgttacaatatcctcacttgttcagttcgtactcaacaagatggaaagattcagagactttatggtttggctactgttgctaa

SEQ ID NO: 18500 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagaccttatggtttggctactgttgctaa

SEQ ID NO: 18501 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgtaggaccgaatgttgcgtctcttggcttgttacaatatcctcacttgttcagttcgtactcaacaagatggaaaggttcagagactttatggtttggctactgttgctaa

SEQ ID NO: 18502 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18503 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctatcaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18504 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaacccttatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18505 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgattcaccagttatgttggaccgaatgttgcgtctcttggcttgttacaatatcctcacttgttcagttcgtactcaacaagatggaaaggttcagagactttatggtttggctactgttgctaa

SEQ ID NO: 18506 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatggaccagttatgttggaccgaatgttgcgtctcttggcttgttacaatatcctcacttgttcagttcgtactcaacaagatggaaaggttcagagactttatggtttggctactgttgctaa

SEQ ID NO: 18507 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttgggccgaatgttgcctctcttgggttgttacaatatcctcacttgttcaggtcgttctcaaccagatggaaaagttcaaagaccttaaggtttggctaacgttgccaa

SEQ ID NO: 18508 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 18509 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggatcgaatgttgcgtctcttgacttgttacaatatcctcacttgttcagttcgtactcaacaagatggaaaggttcagagactttatggtttggctactgttgctaa

SEQ ID NO: 18510 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18511 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 18512 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18513 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18514 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacattatcctcacttgttcagttcgtactcaacaagatggaaaggttcagagactttatggtttggctactgttgctaa

SEQ ID NO: 18515 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactttgctaa

SEQ ID NO: 18516 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 18517 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggctagttacaatatcctcacttgttcagttcgtactcaacaagatggaaaagttcagagactttatggtttggctactgttgctaa

SEQ ID NO: 18518 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18519 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaagatggaaaggttcagagactttatggtttggctactgttgctaa

SEQ ID NO: 18520 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 18521 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 18522 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatattgcgtctcttggcttgttacaatatcctcacttgttcagttcgtactcaaccagatggaaatgttcagagcctttatggtttggcgactgttgctaa

SEQ ID NO: 18523 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttccgttcgtactcaacaagatggaaaggttcagagactttatggtttggctactgttgctaa

SEQ ID NO: 18524 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtccagagactttatggttcggctactgttgctaa

SEQ ID NO: 18525 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 18526 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgatacaatatcctcacttgttcagttcgttctcaacaagatggaaagattcagagactttatggtttggctactgttgctaa

SEQ ID NO: 18527 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 18528 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagatgcagagactttatggtttggctactgttgctaa

SEQ ID NO: 18529 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagtgactttatggtttggctactgttgctaa

SEQ ID NO: 18530 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttctaa

SEQ ID NO: 18531 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgcactcaacaagatggaaaagttcagagactttatggtttggctactgttgctaa

SEQ ID NO: 18532 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttgggttgttacaatatcctcacttgttcagttcgtactcaacaagatggaaagattcagagactttatggtttggctactgttgctaa

SEQ ID NO: 18533 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaggttcagagactttatggtttggcactgttgctaa

SEQ ID NO: 18534 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgaaaaggttcagagactttatggtttggctactgttgctaa

SEQ ID NO: 18535 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctag

SEQ ID NO: 18536 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 18537 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctact

SEQ ID NO: 18538 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcttactcaacaagatggaaaggttctgagactttatggtttggctactgttgctaa

SEQ ID NO: 18539 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctctcggcttgttacagtatcctcacttgttcagttcgtactcaacaagatggaaaagttcagagactttatggtttggctactgttgctaa

SEQ ID NO: 18540 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 18541 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcgcttgttcagttcgtactcaacaagatggaaaggttcagaggctttatggtttggctactgttgctaa

SEQ ID NO: 18542 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaagattcagagactttatggtttggctactgttgctaa

SEQ ID NO: 18543 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtcgcttggcttgttacaatatcctcacttgttcagttcgtactcaacaagatggaaagggtcagagactttatggtttggctactgttgctaa

SEQ ID NO: 18544 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 18545 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggactgaatgttgcgtctcttggcttgttacaatatcctcacttgttcagttcgtactcaacaagatggaaaggttcagagactttatggtttggctactgttgctaa

SEQ ID NO: 18546 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcgcttgttcagttcgtactcaacaagatggaaaagttcagagactttatggtttggctactgttgctaa

SEQ ID NO: 18547 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttactaa

SEQ ID NO: 18548 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttgtggtttggctactgttgctaa

SEQ ID NO: 18549 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcactttttcagttcctactcaacaagatggaaaggttcagagactttatggtttggctactgttgctaa

SEQ ID NO: 18550 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 18551 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 18552 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggcactgttgctaa

SEQ ID NO: 18553 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagatactttatggtttggctactgttgctaa

SEQ ID NO: 18554 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttgcttgttacaatatcctcacttgttcagttcgtactcaacaagatggaaaagttcagagactttatggtttggctactgttgctaa

SEQ ID NO: 18555 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgtggcgtctcttggcttgttacaatatcctcacttgttcagttcgtactcaacaagatggaaagattcagagactttatggtttggctactgttgctaa

SEQ ID NO: 18556 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttgggttgttacaatatcctcacttgttcagttcgtactcaacaagatggaaaggttcagagactttatggtttggctactgttgctaa

SEQ ID NO: 18557 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 18558 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 18559 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatattctcacttgttcagttcgtactcaacaagatggaaaggttcagagactttatggtttggctactgttgctaa

SEQ ID NO: 18560 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 18561 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 18562 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgtaa

SEQ ID NO: 18563 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgtgctaa

SEQ ID NO: 18564 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagtctttatggtttggctactgttgcta

SEQ ID NO: 18565 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttagcttgttacaatatcctcacttgttcagttcgtactcaacaagatggaaaagttcagagactttatggtttggctactgttgctaa

SEQ ID NO: 18566 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 18567 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 18568 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 18569 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttgctactgttgctaa

SEQ ID NO: 18570 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaaagttcagagcctttatggtttggctactgttgctaa

SEQ ID NO: 18571 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 18572 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgcctcttggcttgttacaatatcctcacttgttcagttcgtactcaacaagatggaaaggttcagagactttatggtttggctactgttgctaa

SEQ ID NO: 18573 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 18574 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgatggaccgaatgttgcgtctcttggcttgttacaatatcctcacttgttcagttcgtactcaacaagatggaaaggttcagagactttatggtttggctactgttgctaa

SEQ ID NO: 18575 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagtcatgttggaccgaatgttgtgtctcttggcttgttacaatatcctcacttgttctgttcgtactcaacaagatggaaaggttcagagactttatggtttggctactgttgctaa

SEQ ID NO: 18576 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18577 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18578 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttgctactgttgctaa

SEQ ID NO: 18579 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 18580 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaatttcagagactttatggtttggctactgttgctaa

SEQ ID NO: 18581 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18582 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcacctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18583 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcaactaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18584 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttcccggctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18585 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaatcgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18586 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattaaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18587 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaacttcacctattgaaattgcttctcagctaccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 18588 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctaaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18589 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgcgcaaatctcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18590 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18591 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctgctgctcaaatttcacctattgaaattgcttctcagctaccaacaactaaccctgatgcaccatttatgttgtaccgaatgttgcgtctcttggcttgttacaatatcctcacttgttcatttcgtactcaacaagatttaaaggttcagagactttatggtttcgctactgttgctaa

SEQ ID NO: 18592 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctagtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18593 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacccggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18594 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacccggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18595 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctgaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18596 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18597 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18598 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18599 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18600 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18601 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaaagctggacctggtgctcaaatttcacctattgaaattgcttctcagctcccaacaactaaccctgatgcaccagtcatgttggaccgaaaggtgcgtctcttggcttgttacaatatcctcacttgttcagttcgtactcaacaagaaggaaaagttcagagactttaaggtttggctactggtgctaa

SEQ ID NO: 18602 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18603 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaaagctggacctggtgctcaaatttcacctattgaaattgcttctcagctaccaacaactaaccctgatgcaccagttatgttggaccgaatgttgcgtctcttggcttgttacaatttcctcacttgttcagttcgtactcaacaagatggaaaagttcagagactttatggtttggctactgttgctaa

SEQ ID NO: 18604 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18605 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18606 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18607 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18608 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18609 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18610 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18611 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgttcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18612 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18613 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18614 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18615 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18616 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctgttcaaattgcttctcagcttccaacaactaaccctgatgcaccagttatgttggaccgaatgttgcgtctcttggcttgttacaatatcctcacttgttcagttcgaactcaacaagatggaaaggttcagagactttatggtttggctactgttgctaa

SEQ ID NO: 18617 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18618 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18619 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18620 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 18621 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18622 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18623 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18624 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgtttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18625 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18626 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 18627 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18628 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18629 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18630 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 18631 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18632 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatgggaaagttcagagactttatggtttgctactgttgctaa

SEQ ID NO: 18633 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactgaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18634 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18635 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18636 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18637 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 18638 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcatttgttcagttcgtactcaacaagatggaaagattcagagactttatggtttggctactgttgctaa

SEQ ID NO: 18639 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggtttgttacaatatcctcacttgttcagttcgtactcaacaagatggaaagattcagagactttatggtttggctactgttgctaa

SEQ ID NO: 18640 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 18641 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 18642 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 18643 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18644 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgtggcgtctcttggcttgttacaatatcctcacttgttcagttcgtactcaacaagatggaaaggttcagagactttatggtttggcactgttgctaa

SEQ ID NO: 18645 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 18646 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttgctactgttgctaa

SEQ ID NO: 18647 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcatcaagatggaaagattcagagactttatggtttggctactgttgctaa

SEQ ID NO: 18648 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaac

SEQ ID NO: 18649 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 18650 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 18651 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgtaacaatatcctcacttgttcagttcgtactcaacaagatggaaagattcagagactttatggtttggctactgttgctaa

SEQ ID NO: 18652 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcgtggcttgttacaatatcctcacttggtctgttcgtactcaacaagatggaaaggttcagagcctttatggtttggctactgttgctaa

SEQ ID NO: 18653 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 18654 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18655 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 18656 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18657 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatacaccagttatgttggaccgaatgttgcgtctcttggcttgttacaatatcctcacttgttcagttcgtactcaacaagatggaaagattcagagactttatggtttggctactgttgctaa

SEQ ID NO: 18658 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctactaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18659 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaatcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18660 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaacccttatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18661 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18662 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18663 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 18664 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18665 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18666 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgagtctcttggcttgttacaatatcctcacttgttcagttcgtactcaacaagatggaaaggttcagagactttatggtttggctactgttgctaa

SEQ ID NO: 18667 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 18668 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctga

SEQ ID NO: 18669 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 18670 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 18671 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacttaacaagatggaaaggttcagagactttatggtttggctactgttgctaa

SEQ ID NO: 18672 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 18673 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 18674 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatattgcgtctcttggcttgttacaatatcctcacttgttcagttcgtactcaacaagatggaaaggttcagagactttatggtttggctactgttgctaa

SEQ ID NO: 18675 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaacggttcagagactttatggtttggctactgttgctaa

SEQ ID NO: 18676 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 18677 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagaatttatggtttggctactgttgctaa

SEQ ID NO: 18678 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttagcgtttggctactgttgctaa

SEQ ID NO: 18679 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcatctcttggcttgttacaatgtcctcacttgttcagttcgtactcaacaagatgggaaggttcagagactttatggtttggctactgttgctaa

SEQ ID NO: 18680 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgtgacaatatcctcacttgttcatttcgtactcaacaagatggaaaggttcagagactttatggtttggctactgttgctaa

SEQ ID NO: 18681 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttgtctactgtttctaa

SEQ ID NO: 18682 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttcctaa

SEQ ID NO: 18683 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagatactttatggtttggctactgttgctaa

SEQ ID NO: 18684 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgcttaa

SEQ ID NO: 18685 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtaatcaacaagatggaaaagttcagagactttatggtttgctactgttgctaa

SEQ ID NO: 18686 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 18687 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttataatatcctcacttgttcagttcgtactcaacaagatggaaaggttcagagactttatggtttggctactgttgctaa

SEQ ID NO: 18688 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 18689 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagacttcatggtttggctactgttgctaa

SEQ ID NO: 18690 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttctaa

SEQ ID NO: 18691 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttagaccgaatgttgcgtctcttggcttgttacaatatcctcacttgttcagttcgtactcaacaagatggaaaggttcagagactttatggtttggctactgttgctaa

SEQ ID NO: 18692 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18693 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18694 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18695 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18696 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18697 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctcgtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18698 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18699 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18700 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18701 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18702 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggtactgttgctaa

SEQ ID NO: 18703 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18704 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 18705 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 18706 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18707 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagccggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18708 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18709 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactggacctggtgctcaaatttcacctattgaaattgcttctcagctaccaacaactaaccctgatgcaccagttattttggaccgaatgttgcgtctcttggcttgttacaatatcctcacttgttcagttcgtactcaacaagatggaaaggttcagagactttatggtttggctactgttgctaa

SEQ ID NO: 18710 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaaggttcagagactttatggtttggctactgatgctaa

SEQ ID NO: 18711 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18712 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18713 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactggacctggtgctcaaatttcacctattgaaattgcttctcagctaccaacaactaaccctgatgcaccagttatgttggaccgaatgttgcgactcttggcttgttacaatatcctcacttgttcagttcgtactcaacaagatggaaagattcagagactttatggtttggctactgttgctaa

SEQ ID NO: 18714 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18715 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 18716 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactggacctggtgcccaaatttcacctattgaaattgcttctcagctcccaacaactaaccctgatgcaccagttgtgttggaccgaatgttgcgtctcttggcttgttacaatatcctcacttgttcagttcgtactcaacaagatggaaagattcagagactttatggtttggctactgttgctaa

SEQ ID NO: 18717 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctgttgctcaaatttcacctattgaaattgcttctcagctaccaacaactaaccctgatgcaccagttatgttgaaccgaatgttgcgtctcttggcttgttacaatatcctcccttgttcagttcgtactcaacatgatagaaaagttcagagacttgatggtttggctactgttgctaa

SEQ ID NO: 18718 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacttattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18719 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18720 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18721 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18722 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18723 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18724 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 18725 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18726 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18727 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 18728 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18729 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctattgttgctaa

SEQ ID NO: 18730 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 18731 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgtccagttcgtactcaacaagatggaaagattcagagactttatggtttggctactgttgctaa

SEQ ID NO: 18732 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 18733 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaaccagatggaaaggttcagagactttatggtttggctactgttgctaa

SEQ ID NO: 18734 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18735 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttgggccgaatgttgcgtctcttggcttgttacaatatcctcacttgttcagttcgtactcaacaagatggaaagattcagagactttatggtttggctactgttgctaa

SEQ ID NO: 18736 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18737 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18738 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18739 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggacagaatgttgcgtctcttggcttgttacaatatcctcacttgttcagttcgtactcaacaagatggaaaagttcagagactttatggtttggctactgttgctaa

SEQ ID NO: 18740 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctctgttgctaa

SEQ ID NO: 18741 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgcactcaacaagatggaaaggttcagagactttatggtttggctactgttgctaa

SEQ ID NO: 18742 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18743 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 18744 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 18745 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgtttagttcgtactcaacaagatggaaaagttcagagactttatggtttggctactgttgctaa

SEQ ID NO: 18746 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 18747 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgctacaatatcctcacttgttcagttcgtactcaacaagatggaaaagttcagagactttatggtttggctactgttgctaa

SEQ ID NO: 18748 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18749 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccaattatgttggaccgaatgttgcgtctcttggcttgttacaatatcctcacttgttcagttcgtactcaacaagatggaaaggttcagagactttatggtttggctactgttgctaa

SEQ ID NO: 18750 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18751 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattacttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18752 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctgatgctcaaatttcacctattgaaattgcttctcagctcccaacaactaaccctgatgcaccagttatgttggaacgaatgttgcgtctcttggcttgttacaatatcctcacttgttcagttcgtactcaacaagatggaaagattcagagactttatggtttggctactgttgctaa

SEQ ID NO: 18753 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctagtgctcaaatttcacctattgaaattacttctcagctcccaacaactaaccctgatgcaccagtcatgttgtacctaatattgcgtctcttgacttgttacaatatcctcacttattctgttcatactcaacaagatgtaaagattcagagactttatgatttagctactgttgctaa

SEQ ID NO: 18754 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18755 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18756 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18757 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18758 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18759 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18760 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18761 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18762 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaccctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18763 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaacataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18764 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaacataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18765 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaacactaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18766 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaacactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18767 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaacactaaagctggacctggtgctcaaatttcacctattgaaattgcttctcagctaccaacaactaaccctgatgcaccagttatgttggaccgaatgttgcgtctcttggcttgttacaatatcctcacttgttccgttcgtactcaacaagatggaaaggttcagagactttatggtttggctactgttgctaa

SEQ ID NO: 18768 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaacactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18769 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaacactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 18770 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18771 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18772 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaattaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18773 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18774 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18775 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18776 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18777 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 18778 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18779 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaataacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18780 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18781 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18782 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaataaagctggacctggtgctcaaatttcacctattgaaattgcttctcagctcccaacaactaaccctgatgcaccagttatgttggaccgaatgttgcgtctcttggcttgttacaatatcctcacttgttcagttcatactcaacaagatggaaagattcagagactttatggtttggctactgttgctaa

SEQ ID NO: 18783 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaataaagctggacctggtgctcaaatttcacctattgaaattgcttctcagctaccaacaactaaccctggtgcaccagttatgttggaccgaatgttgcgtctcttggcttgttacaatatcctcacttgttcagttcgtactcaacaagatggaaaggttcagagactttatggtttggctactgttgctaa

SEQ ID NO: 18784 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18785 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18786 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 18787 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaataaagctggacctggtgctcaaatttcacctattgaaattgcttctcagctaccaacaactaaccctgatgcaccagttatgttggaccgaatgttgcgtctcttggcttgttacaatatcctcacttgtttagttcgtactcaacaagatggaaaggttcagagactttatggtttggctactgttgctaa

SEQ ID NO: 18788 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagcttgacctggtgctcaaatttctcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcgactgttgctaa

SEQ ID NO: 18789 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggccctggtgctcaaatttcacctattgaaattgcttctcagctcccaacaactaacccgaatgcaccagttattttggaccgaatgtggcgtctcttggcttgtaacaatatcctcacttgttcagttcgtactcaacaagatggaaaggttcaggaactttagggtttggcactgttgctaa

SEQ ID NO: 18790 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaattttacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctta

SEQ ID NO: 18791 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18792 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcatctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18793 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcaccttttgaaattgcttctcagctcccaccaactaaccctgatgcaccagttatgttggaccgaatgttgcgtctcttggcttgttacaatatcctcacttgttcagttcgtactcaacaagatggaaaggttcagagactttatggtttggctactgttgcaaa

SEQ ID NO: 18794 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18795 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18796 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggataggttcagagactttatggtttggctactgttgctaa

SEQ ID NO: 18797 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 18798 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18799 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18800 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18801 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctccgctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18802 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagcttccaacaactaaccctgatgcaccagttatgttggaccgaatgttgcgtctcttggcttgttacaatatcctcacttgttcagttcgtacccaacaagatggaaagattcagagactttatggtttggctactgttgctaa

SEQ ID NO: 18803 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18804 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18805 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaaccactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18806 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctggtgcaccagttatgttggaccgaatgttgcgtctcttggcttgttacaatatcctcacttgttcagttcgtactcaacaagatggaaaggttcagagactttatggtttggctactgttgctaa

SEQ ID NO: 18807 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18808 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18809 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18810 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaagattcagagactttatggtttggctactgttgctaa

SEQ ID NO: 18811 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgtgacaatatcctcacttgttcagttcgttctcaacaagatggaaaggttcagagactttatggtttggctactgttgctaa

SEQ ID NO: 18812 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttgacttgttacaatatcctcacttgttcagttcgtactcaacaagatggaaaagttcagagactttatggtttggctactgttgctaa

SEQ ID NO: 18813 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagacgttatggtttggctactgttgctaa

SEQ ID NO: 18814 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatggaaaagttcagagactttatggtttggctactgttgctaa

SEQ ID NO: 18815 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18816 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcactttttcagtccgtactcaacaagatggaaagattcagagactttatggtttggctactgttgctaa

SEQ ID NO: 18817 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 18818 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 18819 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggacccaatgttgcgtctcttggcttgttacaatatcctcacttgttctgttcgtactcaacaagatggaaaggttcagagactttattgtttggctactgttgctaa

SEQ ID NO: 18820 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctaatgttgctaa

SEQ ID NO: 18821 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacgactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18822 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaatcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18823 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctggtgtaccagttatgttggaccgaatgttgcgtctcttggcttgttacaatatcctcacttgttcagttcgtactcaacaagatggaaaggttcagagactttatggtttggctactgttgctaa

SEQ ID NO: 18824 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgattcaccagttatgttggaccgaatgttgcgtctcttggcttgttacaatatcctcacttgttcagttcgtactcaacaagatggaaaggttcagagactttatggtttggctactgttgctaa

SEQ ID NO: 18825 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgtaccagttatgttggaccgaatgttacgtctcttggcttgttacaatatcctcacttgttcagttcgtactcaacaagatggaaaggttcagagactttatggtttggctactgttgctaa

SEQ ID NO: 18826 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcagcagttatgttggaccgaatgttgcgtctcttggcttgttacaatatcctcacttgttcagttcgtactcaacaagatggaaaggttcagagactttatgggttggctactgttgctaa

SEQ ID NO: 18827 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 18828 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18829 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18830 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18831 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 18832 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18833 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 18834 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttagaatatcctcacttgttcagttcgtactcaacaagatggaaaggttcagagactttatggtttggctactgttgctaa

SEQ ID NO: 18835 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 18836 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 18837 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatgtttggctactgttgctaa

SEQ ID NO: 18838 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaaagttgcgtctcttggcttgttacaatatcttcacttgttcagttcgtactcaacaagatggaaagattcagagactttatggtttggctactgttgctaa

SEQ ID NO: 18839 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcctggctggttacaatatcctcacttgttcagttcgtactcaacaagatggaaaggttcagagactttatggtttggctactgttgctaa

SEQ ID NO: 18840 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaataacctcacttgttcagttcgtactcaacaagatggaaaggttcagagactttatggtttggctactgttgctaa

SEQ ID NO: 18841 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 18842 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcatcacttgttcagttcgtactcaacaagatggaaaggttcagagactttatggtttggctactgttgcgaa

SEQ ID NO: 18843 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 18844 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatcttgcgtctcttggcttgttacaatatcctcacttgttcagttcgtactcaacaagatggaaaggttcagagactttatggtttggctactgttgctaa

SEQ ID NO: 18845 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 18846 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcaattcgtactcaacaagatggaaagattcagagactttatggtttggctactgttgctaa

SEQ ID NO: 18847 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatagaaagattcagagactttatggtttggctactggtgctaa

SEQ ID NO: 18848 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatagaaaggttcagagactttatggtttggctactgttgctaa

SEQ ID NO: 18849 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcatctcttggcatgttacaatatcctcacttgttcagttcgtgctcaacaagatggaaaagttcagagactttatggtttggctactgttgctaa

SEQ ID NO: 18850 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgttctcaacaagatggaaaagttcagagactttatggtttggctacttttgctaa

SEQ ID NO: 18851 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcttcacttgttcagttcgtactcaacaagatggaaagattcagagactttatggtttggctactgttgctaa

SEQ ID NO: 18852 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggttggctactgttgctaa

SEQ ID NO: 18853 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18854 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18855 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18856 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattcttctcagctaccaacaactaacccttatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18857 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaactaaatctggacctggtgctcaaatttcacctattgaaattgcttctcagctaccaacaactaaccctgatgcaccagttatgttggaccgaatgttgcgtctcttggcttgttacaatatcctcacttgctcagttcgtactcaacaagatggaaaggttcagagactttatggtttggctactgttgctaa

SEQ ID NO: 18858 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaactaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 18859 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18860 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18861 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaactaaagctggacctggtgctcaaatttcacctattgaaattgcttctcagctcccaacaactaaccctgatgcaccagttatgttggaccgaacgttgcgtctcttggcttgttacaatatcctcacttgttcagttcgtacgcaacaagatggaaaggttcagagactttatggtttggctactgttgctaa

SEQ ID NO: 18862 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtgctaa

SEQ ID NO: 18863 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18864 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18865 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18866 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 18867 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaactaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18868 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaacaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18869 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagttggacctggtgctcaaatttcgcctattgaaattgcttctcagctcccaacaactaaccctgatgcaccagttatgttggaccgaatgttgcgtctcttggcttgttacaatatcctcacttgttcatttcgtactcaacaagatggaaagattcagagactttatggtttggctactgttgctaa

SEQ ID NO: 18870 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18871 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcacatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18872 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctgttcaaattgcttctcagcttccaacaactaaccctgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 18873 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18874 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18875 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18876 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18877 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 18878 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18879 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18880 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctctgctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18881 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctccgctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18882 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctccgctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18883 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18884 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18885 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacagctaaccctgatgcaccagttatgttggaccgaatgttgcgtctcttggcttgttacaatatcctcacttgttcagttcgttctcaacaagatggaaaggttcagagactttatggtttggctactgtttctaa

SEQ ID NO: 18886 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18887 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18888 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18889 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaaa

SEQ ID NO: 18890 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 18891 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18892 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 18893 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgagtcccttggcttgttacaatatcctcacttgttcagttcgtactcaacaagatggaaagattcagagactttatggtttggctactgttgctaa

SEQ ID NO: 18894 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccaatgttgcgtctcttggcttgttacaatatcctcacttgttcagttcgtactcaacaagatggaaagattcagagactttatggtttggctactgttgctaa

SEQ ID NO: 18895 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18896 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgcaa

SEQ ID NO: 18897 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 18898 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactgaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18899 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 18900 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 18901 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18902 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcatcaagatggaaaggttcagagactttatggtttggctactgttgctaa

SEQ ID NO: 18903 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18904 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18905 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 18906 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggcttggctactgttgctaa

SEQ ID NO: 18907 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaattttgcgtctcttggcttattacaatatcctcacttgttcagttcgtactcaacaagattgaaacgttcagagactttatggtttggctactgttgctaa

SEQ ID NO: 18908 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 18909 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18910 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 18911 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggttactgttgctaa

SEQ ID NO: 18912 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 18913 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctctgttgctaa

SEQ ID NO: 18914 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttacgtctcttggcttgttacaatatcctcacttgttcagttcgtactcaacaagatggaaaggttcagagactttatggtttggctactgttgctaa

SEQ ID NO: 18915 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtcgcttggcttgttacaatatcctctcttgttcagttcgtactcaacaagatggaaaggttcagagactttatggtttggctactgttgctaa

SEQ ID NO: 18916 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 18917 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgaactcaacaagatggaaaagttcagagactttatggtttggctactgttgctaa

SEQ ID NO: 18918 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 18919 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagaaggaaaggttcagagactttatggtttggctactgttgctaa

SEQ ID NO: 18920 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctaacgtgttcagttcgtactcaacaagatggaaaggttcagagactttatggtttggctactgttgctaa

SEQ ID NO: 18921 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 18922 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18923 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18924 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttaacctattgaaattgcttctcagctaccaacatctaaccctgatgcacaagttatgttggaccgaatgttgcgtctcttggcttgttacaatatcctcacttgttcagttcgtactcaacaagatggaaaggttcagagactttatggtttggctactggtgctaa

SEQ ID NO: 18925 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggaccaggtgctcaaatttcacctattgaaattgctgctcagctaccaacaactaaccctgatgcaccagttatgttggaccgaattttgcgtctcttggcttgttacaatatcctcacttgttcagttcgtactcaacaagatggaaaggttcagagactttatggttgggctactgttgctaa

SEQ ID NO: 18926 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctgcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18927 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagccggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18928 - DNA, 305 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18929 - DNA, 305 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18930 - DNA, 305 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18931 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 18932 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctgccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18933 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctcccaacaactaaccctgatgcaccagttatgttggaccgaatgttgcgtcacttggcttgttacaatatcctcacttgttcagttcgtactcaacaagatggaaagattcagagactttatggtttggctactgaagctaa

SEQ ID NO: 18934 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctcccaacaactaaccctgatgcaccagttatgttggaccgaatgtttcgtctcttggcttgttacaatatcctcacttgttcagttcgtactcaacaagatggaaagattcagagactttatggtttggctactgttgctaa

SEQ ID NO: 18935 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18936 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18937 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgctgctaa

SEQ ID NO: 18938 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctcccaacaactaaccctgatgcaccagttacgttggaccgaatgttgcgtctcttggcttgttacaatatcctcacttgttcagttcgtactcaacaagatggaaaggttcagagactttatggtttggctactgttgctaa

SEQ ID NO: 18939 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18940 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18941 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18942 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 18943 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 18944 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18945 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaagatcctcacttgttcagttcgtactcaacaagatggaaaggttcagagactttatggtttggctactgttgctaa

SEQ ID NO: 18946 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgagtgttgcgtctcttggcttgttacaatatcctcacttgttcagttcgtactcaacaagatggaaaggttcagagactttatggtttggctactgttgctaa

SEQ ID NO: 18947 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcactttttcagttcgtactcaacaagatggaaaggttcagagcctttatggtttggctactgttgctaa

SEQ ID NO: 18948 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctattgttgctaa

SEQ ID NO: 18949 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18950 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactggggggtcaagccgtgggcctggcacagcaccggcaacagccgctggaccgtctccagcgcctgcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18951 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactggggggtcaagccgtgggcctggcacagcaccggcaacagccgctggaccgtctccagcgcctgcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18952 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactggggggtcaagccgtgggcctggcacagcaccggcaacagccgctggaccgtctccagcgcctgcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18953 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactggggggtcaagccgtgggcctggcaaagcaccggcaacagccgctggaccgtctccagcgcctgcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18954 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgttcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18955 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18956 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18957 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctattgaaattgcttctcagttaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18958 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctattgaaattgcttctcagctcccaacaactaaccctgatgcactagttatgttggaccgaatgttgcgtctcttggcttgttacaatatcctcacttgttcagttcgtactcaacaagatggaaaggttcagagactttatggtttggctactgttgctaa

SEQ ID NO: 18959 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18960 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18961 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18962 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18963 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagctcagagactttatggtttggctactgttgctaa

SEQ ID NO: 18964 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18965 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18966 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 18967 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18968 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctatcgaaattgcttctcagctaccaacaactaaccctgatgcaccagttatgttggaccgaatgttgcgtctcttggcttgttacaatatcctcacttgttcagttcgtgctcaacaagatggaaaggttcagagactttatggtttgctactgttgctaa

SEQ ID NO: 18969 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18970 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18971 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18972 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18973 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18974 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttacctggtgctcaaatttcacctattgaaattgcttctcagctaccaacaactaaccctgatgcaccagttatgttggaccgaatgttgcgtcacttggcttgttacaatatcctcacttgttcagttcgtactcaacaagatggaaaggttcagagactttatggtttggctactgttgctaa

SEQ ID NO: 18975 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttacctggtgctcaaatctcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18976 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttacaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18977 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttacaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18978 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaatctggacctggtgctcaaatttcacctattgaaattgcttctcagctaccaacaactaacccttatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18979 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18980 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18981 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18982 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18983 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18984 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18985 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaggctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18986 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctgttcaaattgcttctcagcttccaacatctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18987 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 18988 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 18989 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 18990 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 18991 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctgccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 18992 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctcccaacagccaaccctgctgcaccagttatgttggaccgaatgtcgcgcctcttggcatgttacaatttcctcacttgttcagttcgtactcaacaagatggaaaggttcagagactttatggtttggctactgttgctaa

SEQ ID NO: 18993 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 18994 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18995 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 18996 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 18997 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaaccagatggaaaagttcagagactttatggtttggctactgttgctaa

SEQ ID NO: 18998 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatgggttggctactgttgctaa

SEQ ID NO: 18999 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttggtcagttcgtactcaacaagatggaaagattcagagactttatggtttggctactgttgctaa

SEQ ID NO: 19000 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctatgttgctaa

SEQ ID NO: 19001 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcatcagttatgttggaccgaatgttgcgtctcttggcttgttacaatatcctcacttgttcagttcgtactcaacaagatggaaaggttcagagactttatggtttggctactgttgctaa

SEQ ID NO: 19002 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggtccgaatgttgcgtctcttggcttgttacaatatcctcacttgttcagttcgtactcaacaagatggaaaggttcagagactttatggtttggctactgttgctaa

SEQ ID NO: 19003 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaattttgcgtctcttggcttgttacaatatcctcacttgttcagttcgtactcaacaagatggaaaggttcagagactttatggtttggctactgttgctaa

SEQ ID NO: 19004 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19005 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19006 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19007 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 19008 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttgtctttttacaatatcctcacttgttcagttcgtactcaacaagatggaaagattcagagactttatggtttggctactgttgctaa

SEQ ID NO: 19009 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgttgcaatatcctcacttgttcagttcgtactcaacaagatggaaagattcagagactttatggtttggctactgttgctaa

SEQ ID NO: 19010 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 19011 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgtcacaatatcctcacttgttcagttcgtactcaacaagatggaaagattcagagactttatggtttggctactgttgctaa

SEQ ID NO: 19012 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19013 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19014 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagcacccaacaactaaccctgatgcaccagttatgttggaacgaatgttgcgtctcttggcttgttacaatatcctcacttgttcagttcgtactcaacaagatggaaaggttcagagactttatggtttggctactgttgctaa

SEQ ID NO: 19015 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatctcacctattgaaattgcttctcagctaccaacaactaaccctgatgcaccagttatgttggaccgaatgttgcgtctcttggcttgttacaatatcctcacttgttcagtgcgtactcaacaagatggaaaggttcagagactttatggtttggctacggttgctaa

SEQ ID NO: 19016 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagccggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19017 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19018 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19019 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19020 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19021 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 19022 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19023 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19024 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 19025 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgagattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19026 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19027 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctcccaacaactgaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19028 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19029 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19030 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 19031 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19032 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19033 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 19034 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19035 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacgactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19036 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19037 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaacccttatgcaccagttatgttggaccgaattttgcggcccctggcttggtacaatatcctcacttgttcagttcgtacccaacaagatggaaaaggtcagagactttatggtttggctactgttgctaa

SEQ ID NO: 19038 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgctccagttatgttggaccgaatgttgcgtctcttggcttgttacaatatcctcacttgttctgttcgtactcaacaagatggaaaggttcagagactttatggtttggctactgttgctaa

SEQ ID NO: 19039 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19040 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagttggaaaggttcagagactttatggtttggctactgttgctaa

SEQ ID NO: 19041 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19042 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtgctcaacaagatggaaaggttcagagactttatggtttggctactgttgctaa

SEQ ID NO: 19043 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19044 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgtttagttcgtactcaacaagatggaaaggttcagagactttatggtttggctactgttgctaa

SEQ ID NO: 19045 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 19046 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 19047 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttagcttgttacaatatcctcacttgttcagttcgtactcaacaagatggaaaggttcagagactttatggtttggctactgttgctaa

SEQ ID NO: 19048 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttagggtttggctactgttgctaa

SEQ ID NO: 19049 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 19050 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagatactttatggtttggctactgttgccaa

SEQ ID NO: 19051 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 19052 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 19053 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctac

SEQ ID NO: 19054 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 19055 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19056 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagattgaaaggttcagagactttatggtttggctactgttgctaa

SEQ ID NO: 19057 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 19058 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttgaaccgaatgttgcgtctcttggcttgttacaatatcctcacttgttcagttcgtactcaacaagatggaaaggttcagagcctttatggtttggctactgttgctaa

SEQ ID NO: 19059 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttcgaccgaatgttgcgtctcttggcttgttacaatatcctcacttgtccagttcgtactcaacaagatggaaaggttcagagactttatggtttggctactgttgctaa

SEQ ID NO: 19060 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaattgcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19061 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19062 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtcctcaaatttcacctattgaaattgcttctcagctcccaacaactaaccctgatgcaccagttatgttggaccgaatgttgcgtctcttggcttgttacaatatcctctcttgttcagttcgtactcaacaagattgaaagattcagagactttatggtttggctactgttgctaa

SEQ ID NO: 19063 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19064 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctagtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 19065 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19066 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19067 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctgtgctcaaatttcacctgttcaaattgcttctcagcttccaacaactaaccctgatgcaccagtcatgttgggccgaatgttgcgtctcttggcttgttacaatatcctcacttgttcagttcgtactcaacaagatggaaaggttcagagactttatggtttggctactgttgctaa

SEQ ID NO: 19068 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctgtgctcaaatttcacctattggaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19069 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctgtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19070 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19071 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctgtgctcaaatttcacctattgaaattgcttctcagctcccaacaactaaccctgatgcaccagttatgttggaccgaatgttgcgtctcttggctcgttacaatatcctcacttgttcagttcgtactcaacaagatggaaaggttcagagactttatggtttggctactgttgctaa

SEQ ID NO: 19072 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19073 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19074 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19075 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19076 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19077 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19078 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcactgttgctaa

SEQ ID NO: 19079 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19080 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19081 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19082 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19083 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19084 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctacggttgctaa

SEQ ID NO: 19085 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctggacctggtgctcaaatttcacctattgaaattgcttctcagctaccaacaactaaccctgatgcaccagttatgttggaccgaatgttgcgtctcttggcttgttacaatatcctcacttgttcagttcgtacgcaacaagatggaaggattcagagactttatggtttggctactgttgctaa

SEQ ID NO: 19086 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctggacctggtgctcaaatttcacctattgaaattgcttctcagctaccaacaactaaccctgatgcaccagttatgttggaccgaatgttgcgtctcttggcttgttgcaatatcctcacttgttctgttcgtactcaacaagatggaaaggttcagagactttatggtttggctactgttgctaa

SEQ ID NO: 19087 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19088 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctggacctggtgctcaaatttcacctattgaaattgcttctcagctaccaacaactaaccctgatgcaccagttatgttggaccgaatgttgcgtctcttggcttgttacaatatccccacttgttcagttcgtactcaacaagatggaaagattcagagactttatggtttggctactgttgctaa

SEQ ID NO: 19089 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19090 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19091 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19092 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctctaaagctagacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19093 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctcagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactggtgctaa

SEQ ID NO: 19094 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctcagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19095 - DNA, 395 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctcagaaatcgtcgattgtcttcattggatcggatcccatcccctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19096 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctcagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19097 - DNA, 322 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 19098 - DNA, 322 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19099 - DNA, 322 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19100 - DNA, 322 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19101 - DNA, 322 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 19102 - DNA, 322 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctattgaaattgcttctcagctaccaacaactaaccctgatgcaccagttatgttggaccgaatgttgcgtctcttggcctgttacaatatcctcacttgttcagttcgtactcaacaagatggaaaggttcagagactttatggtttggctactgttgctaa

SEQ ID NO: 19103 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19104 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19105 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19106 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19107 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 19108 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19109 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19110 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 19111 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19112 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19113 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19114 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatagaaaagttcagagaatttatggtttggcgactgttgctaa

SEQ ID NO: 19115 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19116 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19117 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaatgttgcgtttcttggcttgttacaatatcctcacttgttcagttcgtactcaacaagatggaaaggttcagagactttatggtttggcttgctaa

SEQ ID NO: 19118 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 19119 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19120 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 19121 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19122 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgtgctaa

SEQ ID NO: 19123 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgcactcaacaagatggaaagattcagagactttatggtttggctactgttgctaa

SEQ ID NO: 19124 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaaggttgcggctcggggcttgttacaatatcctcagttgttaagtgcgtacgcaacaagatggaaaggttcagagactttatggttgggctacggttgctaa

SEQ ID NO: 19125 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19126 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcgtagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19127 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcgtagaagctggacctggtgctcaaatttcacctattgaaattgcttctcagctaccaacaactaaccctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19128 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcggcttgaccccggagcaggtggtggccatcgccagcaatattggtggcaagcaggcgctggagacggtgcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19129 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcggcttgaccccggagcaggtggtggccatcgccagcaatattggtggcaagcaggcgctggagacggtgcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19130 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcggcttgaccccggagcaggtggtggccatcgccagcaatattggtggcaagcaggcgctggagacggtgcagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19131 - DNA, 416 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcggcttgaccccggagcaggtggtggccatcgccagcaatattggtggcaagcaggcgctggacctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19132 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcggcttgaccccggagcaggtggtggccatcgccagcaatattggcggcaagcaggcgctggagacggtgcagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19133 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcggcttgaccccggagcaggtggtggccatcgccagcaatattggcggcaagcaggcgctggagacggtgcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 19134 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcggcttgaccccggagcaggtggtggccatcgccagcaatattggcggcaagcaggcgctggagacggtgcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19135 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcgctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19136 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcgctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19137 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19138 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 19139 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19140 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19141 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19142 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19143 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 19144 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcgctggacctggtgctcaaatttcacctattgaaattgcttctcagctaccaacaactaaccctgatgcaccagttatgttggaccgaatgttgcgtctcttggcttgttacaatatgctcacttgttcagttcgtactcaacaagatggaaaggttcagagactttatggtttggctactgttgctaa

SEQ ID NO: 19145 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcctagaagctggacctggtgctcaaatttcacctattgaaattgcttctcagctaccaacaactaaccctgatgcaccagttatgttggaccgaatgttgcgtctcttgtcttgttacaatatcctcacttgttcagttcgtactcaacaagatggaaaggttcagagactttatggtttggctactgttgctaa

SEQ ID NO: 19146 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcctagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19147 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19148 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcactaaagctgtacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19149 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19150 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19151 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19152 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 19153 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 19154 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcactaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19155 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcaagctggacctggtgctcaaatttcacctgttcaaattgcttctcagcttccaacaactaaccctgatgcaccagtcatgttggaccgaatgttgcgtctcttggcttgttaaatatcctcacttgttctgttcgtactcaacaagatggaaaggttcagagactttatggtttggctactgttgctaa

SEQ ID NO: 19156 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19157 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggtactgttgctaa

SEQ ID NO: 19158 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19159 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19160 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcaagctggacctggtgctcaaatttcacctattgaaattgcttctcagctaccaacaactaaccctgatgcaccagttatgttggaccgaatgtttcgtctcttggcttgttacaatatcctcacttgttcagttcgtactcaacaagatgtaaaggttcagagactttatggtttcgctactgttgctaa

SEQ ID NO: 19161 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19162 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19163 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19164 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcaagctggacctggtgctcaaatttcacctattgaaattgcttctcagctaccaacaactaaccctgatgcaccagttatgttggaccgaatgttgcgtctcttggcttgttaaatatcctcacttgttcagttcgtactcaacaagatggaaaggttcagagactttatggtttggctactgttgctaa

SEQ ID NO: 19165 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcatagactttatggtttggctactgttgctaa

SEQ ID NO: 19166 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19167 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19168 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19169 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19170 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19171 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaagctggacctggtgctcaaatttcacctattgaaattgcttctcagctaccaacaactatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19172 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19173 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19174 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaagctggacctggtgctcaaatttcacctattgaaattgcttctcagctaccaacaactaaccctgatgcaccagttatgttggaccgaatgttgcgtctcttggcttgttacaatatcctcacttgttcatttcgtactcaacaagatggaaaggttcagagactttatggtttggctactgttgctaa

SEQ ID NO: 19175 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19176 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19177 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctgttcaaattgcttctcagcttccaacaactaaccctgatgcaccagttatgttggaccaaatgttgcgtctcttggcttgttacaatatcctcacttgttcagttcgtactcaacaagatggaaagattcagagactttatggtttggctactgttgctaa

SEQ ID NO: 19178 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19179 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactgtatggtttggctactgttgctaa

SEQ ID NO: 19180 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatgggttggctacctgttgctaa

SEQ ID NO: 19181 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19182 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19183 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19184 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19185 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctaccaacagctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19186 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19187 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19188 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19189 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 19190 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacagtatcctcacttgttcagttcgtactcaacaagatggaaaggttcagagactttatggtttggctactgttgctaa

SEQ ID NO: 19191 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgctacaatatcctcacttgttcagttcgtactcaacaagatggaaagattcagagactttatggtttggctactgttgctaa

SEQ ID NO: 19192 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacaacatcctcacttgttcagttcgtactcaacaagatggaaaggttcagagactttatggtttggctactgttgctaa

SEQ ID NO: 19193 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19194 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgcgaa

SEQ ID NO: 19195 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaac

SEQ ID NO: 19196 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgcctcttggcttgttacaatatcctcacttgttcagttcgtactcaacaagatggaaaagttcagagactttatggtttggctactgttgctaa

SEQ ID NO: 19197 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggtactgttgctaa

SEQ ID NO: 19198 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcaactaccaacaactaaccctgatgcaccagttatgttggaccgaatcttgcgtctcttaacttgttacaatatcctcactttttcatttcgtactcaacaagatggaaaggttcagagactttatggtttgactactgttactaa

SEQ ID NO: 19199 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacatattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19200 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcgctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19201 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19202 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19203 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcgctggacctggtgctcaaatttcacctattgaaattgcttctcagctaccaacaactaaccctgatgcactagttatgttggaccgaatgttgcgtctcttggcttgttacaatatcctcacttgttcagttcgtactcaacaagatggaaagattcagagactttatggtttggctactttgctaa

SEQ ID NO: 19204 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19205 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 19206 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19207 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcgccggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctattgctaa

SEQ ID NO: 19208 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19209 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19210 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19211 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19212 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcccttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19213 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcccttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19214 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatatcttagagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19215 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatatcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19216 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatatcttagaaatctacagctggacctggtgctcaaatttcacctattgaaattgcttctcagctaccaacaactaaccctgatgcaccagttatgttggcctgaatgttgcgtctcttggcatgttacactatcctcacttgttcagttcgtactcaacaagatggaaaagttcagagactttatggtttggctactggtgctaa

SEQ ID NO: 19217 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatatcttagaaatctaaagctggacctggtgctcaaatttcacctattgaaattgcttctcagctaccagcaactaaccctgatgcaccagttatgttggaccgaatgttgcgactctgggcttgttacaatatcctcacttgttcagttcgtactcaacaagatagaaaggttcagagactttatggtttggctactgttgctaa

SEQ ID NO: 19218 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatatcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19219 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19220 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19221 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19222 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 19223 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19224 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19225 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19226 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19227 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19228 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcttctgttgctaa

SEQ ID NO: 19229 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 19230 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgataaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 19231 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgataaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19232 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgataaagctggacctggtgctcaaatttcacctattgaaattgattctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19233 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19234 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19235 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19236 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19237 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19238 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19239 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19240 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19241 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19242 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19243 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19244 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19245 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19246 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19247 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19248 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19249 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgacctcttagaaatcgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 19250 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgacctcttactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19251 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19252 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19253 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19254 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19255 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19256 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19257 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttgctactgttgctaa

SEQ ID NO: 19258 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19259 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19260 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19261 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19262 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttcatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19263 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19264 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19265 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 19266 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19267 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19268 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttaatctcttagaaatcagctggacctggtgctcaaatttcccctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19269 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19270 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19271 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19272 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19273 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19274 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19275 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19276 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19277 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactctatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19278 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 19279 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19280 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19281 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19282 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaataaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19283 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 19284 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaacactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19285 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19286 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggatactgttgctaa

SEQ ID NO: 19287 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19288 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19289 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19290 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19291 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19292 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19293 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19294 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 19295 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 19296 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19297 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19298 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19299 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactaaagctggacctggtgctcaaatttcacctattgaaattgcttctcaactcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19300 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactaaagctggacctggtgatcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19301 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctggtgctcaaatttcacctattgaaattgcttctcagctcccaacaactaaccctgatgcaccagttatgttggaccgaatgttgcgtctcttggcttgttacaatatcctcacttgttcagttcgtgctcaacaagatggaaaggttcagagactttatggtttggctactgttgctaa

SEQ ID NO: 19302 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19303 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctggtgctcaaatttcacctattgaaattgcttctcagctatcaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 19304 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19305 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19306 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19307 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19308 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19309 - DNA, 295 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctaccaacaactaaccctgatgcaccagttatgttgggccgaatgttgcgtctcttggcttgttacaatatcctcacttgttcagttcgtactcaacaagatggaaaagttcagagactttatggtttggctactgttgctaa

SEQ ID NO: 19310 - DNA, 295 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19311 - DNA, 295 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19312 - DNA, 295 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19313 - DNA, 295 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19314 - DNA, 295 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctaccaacaactaaccctgatgcaccagttatgttggaccgaatgttgcgtctcttggcttgttacaatatcctcacttgttcagttcgtactcaacaagatggaaaggttcagagaaattatggtttggctactgttgctaa

SEQ ID NO: 19315 - DNA, 295 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctaccaacaactaaccctgatgcaccagttatgttggaccgaatgttgcgtctcttggcttgttacaatatcctcacttgttcagttcgtactcaacaagatggaaaagttcagagactttatggttttgctactgttgctaa

SEQ ID NO: 19316 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaaaatggaaaggttcagagactttatggtttggctactgttgctaa

SEQ ID NO: 19317 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacatgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19318 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19319 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19320 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19321 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19322 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19323 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgcta

SEQ ID NO: 19324 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19325 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19326 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19327 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaattgcttctcagctaccaaccactaaccctgatgcaccagttatgttggaccgaatgttgcgtctcttggcttgttacaatatcctcacttgttcagttcgtcaccaacaagatggaaaggttcagagactttatggtttggctactgttgctaa

SEQ ID NO: 19328 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaattgcttctcagctaccaacaactaaccctgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 19329 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19330 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19331 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19332 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19333 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaagctgggcctggtgctcaaatttcacctgttcaaattgcttctcagcttccaacaactaaccctgatgcaccagtcatgttggaccgaatgttgcgtctcttggcctgttacaatatcctcccttgttctgttcgttctcaacaagatggaaaggttcagagaccttatggtttggctactgttgctaa

SEQ ID NO: 19334 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 19335 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19336 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19337 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19338 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19339 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggcactgttgctaa

SEQ ID NO: 19340 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19341 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggttactgttgctaa

SEQ ID NO: 19342 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19343 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19344 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19345 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19346 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19347 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtgctcaacaagatggaaagattcagagactttatggtttggctactgttgcta

SEQ ID NO: 19348 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19349 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19350 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 19351 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19352 - DNA, 335 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19353 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19354 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19355 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19356 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19357 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttaagctggacctggtgctcaaatttcacctattgaaattgcttctcagctaccaacaactaaccctgatgcaccagttatgttggaccgaatgttgcgtctcttggcttgctacaatatcctcacttgttcagttcgtactcaacaagatggaaaggttcagagactttatggtttggctactgttgctaa

SEQ ID NO: 19358 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19359 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19360 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttaagctggacctggtgctcaaatttcacctattgaaattgcttctcagctaccaacaactaaccctgatgcaccagttatgttggaccgaaagttgcgtctcttggcttgttacaatatcctcacttgttcagttcgtactcaacaagatggaaaagttcagagactttatggtttggctactgttgctaa

SEQ ID NO: 19361 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19362 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttaaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19363 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctcgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19364 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctcgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19365 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctcgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19366 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctcgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19367 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctagaacttgatctcttagaaattaaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcgaa

SEQ ID NO: 19368 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcgtgaacttgatctcggcttgaccccggagcaggtggtggccatcgccagcaatattggcggcaagcaggcgctggagacggtgcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19369 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcctgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19370 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcctgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatagtttggctactgttgctaa

SEQ ID NO: 19371 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcatgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19372 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcatgaacttgatctcttagaaatcagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19373 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcatgaacttgatctcttagaaataaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19374 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctattgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagacggaaaggttcagagaatttatggtttggctactgttgctaa

SEQ ID NO: 19375 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctattgaacttgatctctggacctgttgctcaaatttcacctattgaaatttcttctcatctaccaacaactaaccctgatgcaccatttattttttacccaattttgcatctcttatcttgttacaatatcctcacttcttcatttcctactcaacaatattaaaattttcacaaactttattgtttatctactgttactaa

SEQ ID NO: 19376 - DNA, 336 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19377 - DNA, 336 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19378 - DNA, 336 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctaaagctggacctggtgctcaaatttcacctattgaaattgcttctcagctaccaacacctaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19379 - DNA, 336 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctaaagctggacctggtgctcaaatttcacctattgaaattgcttctcagctaccaacaactaaccctgatgcaccagttatgttggaccgaatgttgcgtctcttggctttttacaatatcctcacttgttcagttcgtactcaacaagatggaaaggttcagagactttatggtttggctactgttgctaa

SEQ ID NO: 19380 - DNA, 336 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19381 - DNA, 336 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19382 - DNA, 336 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19383 - DNA, 336 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaaattcagagactttatggtttggctactgttgctaa

SEQ ID NO: 19384 - DNA, 337 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcctaa

SEQ ID NO: 19385 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagcgcttgaacttgatggacctggtgctcaaatttcacctattgaaattgcttctcagctaccaacaactaaccctgatgcaccagttatgttggaccgaatgttgcgtctcttggcttgttacaatatcctcacttgttcagttcttactcaacaagatggaaagattcagagactttatggtttggctactgttgctaa

SEQ ID NO: 19386 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagcccttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19387 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagcccttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19388 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagcccttgaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19389 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagcacttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19390 - DNA, 322 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagcacttgaacttgatctctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19391 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagcacttgaacttctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19392 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19393 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19394 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcacctattgaaattgcttctcagctaccaacaactaaccctgatgcaccagttatgttggaccgaatgttgcgtctcttggcttgttacaatatcctcacttgttcagttcgtcctcaacaagagagaaaagttcagagcctttatggtttggctactgttactaa

SEQ ID NO: 19395 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19396 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19397 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcacctattgaaattgcttctcagcccccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19398 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcaactcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19399 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19400 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19401 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19402 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaagcagctcttgaacttgatctcttagaaatctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttactaa

SEQ ID NO: 19403 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaaccagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19404 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaaccagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19405 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaaccagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19406 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaaccagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19407 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaaccagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19408 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaaccagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19409 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttataatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19410 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaagatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19411 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19412 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatccgctcttgaacttgatctcttagaaataagctggacctggtgctcaaatttctcctattgaaattgcttcgcagctcccaacaactaaccctgatgcaccagttatgttggaccgaatgttgcgtctcttggcttgttacaatatcctcacttgttcagttcgtactcaacaagatgtaaaggttcagagactttatggtttggctactgttgctaa

SEQ ID NO: 19413 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagttcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgctaa

SEQ ID NO: 19414 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgtctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19415 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgtctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19416 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgtctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19417 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgagcttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19418 - DNA, 337 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgactggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 19419 - DNA, 337 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19420 - DNA, 337 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19421 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19422 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19423 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaatttcacctgttcaaattgcttcccagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19424 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19425 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaagctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19426 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaagctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19427 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaagctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 19428 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19429 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19430 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19431 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaactttatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19432 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaactttaaagctggacctggtgctcaaatttcacctattgaaattgcttctcagctcccaacaactaaccctgatgcaccagttatgttggactgaatgttgcgtctcttggcttgttacaatatcctcacttgttcagttcgtactcaacaagatggaaaggttcagagactttatggtttggctactgttgctaa

SEQ ID NO: 19433 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaactttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19434 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgttctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19435 - DNA, 332 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19436 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatttcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19437 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19438 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgattaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttga

SEQ ID NO: 19439 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19440 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19441 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgattaaagccggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19442 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatgctaaagctggacctggtgctcaaatctcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19443 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19444 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19445 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatcttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19446 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatcttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19447 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19448 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19449 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19450 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatcttaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19451 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19452 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19453 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttggacctggtgctcaaatttcacatattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19454 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19455 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19456 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19457 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19458 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19459 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19460 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19461 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19462 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttataaatctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 19463 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19464 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19465 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19466 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19467 - DNA, 464 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagtccagcgcctgcttgccaccgccattgctggcgatggccaccacctgctggggggtcaagccgtgggcctggcacagcaccggcaacagccgctggaccgtctccagctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19468 - DNA, 464 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagtccagcgcctgcttgccaccgccattgctggcgatggccaccacctgctggggggtcaagccgtgggcctggcacagcaccggcaacagccgctggaccgtctccagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19469 - DNA, 464 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagtccagcgcctgcttgccaccgccattgctggcgatggccaccacctgctggggggtcaagccgtgggcctggcacagcaccggcaacagccgctggaccgtctccagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19470 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagtaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 19471 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagtaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19472 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagtaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19473 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19474 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcactgttgctaa

SEQ ID NO: 19475 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19476 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19477 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaggctaaagctggtcctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19478 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaggctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 19479 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaggctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19480 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaggctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19481 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagggactttatggtttggctactgttgctaa

SEQ ID NO: 19482 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19483 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19484 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttcgctactgttgctaa

SEQ ID NO: 19485 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 19486 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagctggacctggtgctcaaatttcacctattgaaattgcttctcagctaccaacaactaaccctgatgcaccggttatgttggaccgaatgttgcgtctcttggcttgttacaatatcctcacttgttcagttcgtactcaacaagatggaaaggttcagagactttatggtttggctactgttgctaa

SEQ ID NO: 19487 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19488 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19489 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19490 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttctaa

SEQ ID NO: 19491 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19492 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19493 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19494 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19495 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19496 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 19497 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19498 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19499 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19500 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19501 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19502 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19503 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19504 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagagtgctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19505 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagagtgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19506 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19507 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagagctggacctggtgctcaaatttcacctgttcaaattgcttctcggctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19508 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19509 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19510 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19511 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19512 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaagattcagagactttatggtttggctactgttgctaa

SEQ ID NO: 19513 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19514 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19515 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 19516 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagagctggacctggtgctcaaatttcacctattgaaattgcttctcagctaccaacaactaaccctgatgcaccagttatgttggtccgaatgttgcgtctcttggcttgttacaatatcctcacttgttcagttcgtactcaacaagatggaaaggttcagagactttatggtttggctactgttgctaa

SEQ ID NO: 19517 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19518 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19519 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagagatcaaagctggacctgttgctctaatttcacctattgcaatttcttctcagctaccaacaactaaccctgatgcaccagttatgttggtccgaatgttgcgtctattagcttgttacaatatcctcacttgttcatttcgtactcaacaagatggaaaagttcagagactttatggtttggctactgttgctaa

SEQ ID NO: 19520 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19521 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 19522 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19523 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19524 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagactggacctggtgctaaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19525 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19526 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19527 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19528 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 19529 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 19530 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagacgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 19531 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19532 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19533 - DNA, 335 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19534 - DNA, 335 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19535 - DNA, 335 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaatttcacctattgaaattgcttctcagctcccaacaactaaccctgatgcaccagttatgttggaccgaatgttgcgtctcttggcttgctacaatatcctcacttgttcagttcgtactcaacaagatggaaaggttcagagactttatggtttggctactgttgctaa

SEQ ID NO: 19536 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaattctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19537 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaattaaaggtggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19538 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19539 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagaaggaaagattcagagactttatggtttggctactgttgctaa

SEQ ID NO: 19540 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19541 - DNA, 399 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaatgtccagcgcctgcttgccggtgctgtgccaggcccacggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19542 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19543 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19544 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19545 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19546 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19547 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaatcctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19548 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19549 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaatcatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 19550 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaatcatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19551 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaatcataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 19552 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa
